United States Patent 10,233,495 (METHODS AND COMPOSITIONS FOR SCREENING AND TREATING DEVELOPMENTAL DISORDERS) - sequence listing, part 69

SEQ ID NO: 621 - DNA, 117792996 bp, Homo sapiens (residues 10,096,549-11,779,306 of 117,792,996)
  misc_feature (358797)..(383796): n is a, c, g, or t
  misc_feature (12480561)..(12530560): n is a, c, g, or t
  misc_feature (13211533)..(13391532): n is a, c, g, or t
  misc_feature (15763259)..(15813258): n is a, c, g, or t
  misc_feature (21949357)..(24949356): n is a, c, g, or t
  misc_feature (39920968)..(39940967): n is a, c, g, or t
  misc_feature (76754544)..(76824543): n is a, c, g, or t
  misc_feature (78946938)..(78966937): n is a, c, g, or t
  misc_feature (106685630)..(106715629): n is a, c, g, or t
  misc_feature (112143340)..(112183339): n is a, c, g, or t
cacagcaacccttaactatcatcattttgcatgggtcaaactatgtcttgtgatttttactttctgaattttgtaagtcaccttaaaaattaaatctttgtgatatgaaattatattggaacattaataaataatttgttttcatgtccttcaacagattttcaaaatcaaatgacttcaattaacatttttaagtactatataaattcaggcctatttagataccccatggtatgaagttactctcagacttgccttttaactaggaactagtcttaaggttttttggcagagctttctatttgccatccatatacccttttcagtgaaatatatctttgtcttttgcctgttttctaatcagattctttgtttttttactattgagtgttgagaattacttataaatttgagatatgaatccattgtcaaatatgtggtttgcaaatattttctcccagtctatttatagattgacttttcgtccagttaagagggtcgttcacaaagtataagtttgtgattttgatgaagttcaatttattgattttttttttcttctggatcatgcttttaatgtcatgctgtgaacttttcacttagctctatgtctcaaaaatattcttctatgttttcttttaagagttttatagttttacatttaaatgcgtgaaccattttgaattaattttgtgtaagatatgaggcatagatcaaagttcaaaatcaggtaagttgattcttcccactttattcatttttcaaaattgctgtggctattccactttctttgtctttccattcaaattttataataagctttccatatgtacaaaaaatcttgctggattttcataaggattatattaaacctttatcacttgggaagaattgacatctgtacaagtcctgtacacattttgctaaatttatgcttaagtgttaaaattttttgagcagttgttaatggtattatatttataatttaggtttccacatggtcattgctagtacatacaaatacaaccaatttttgtgtgttgatgttgtgttttctataaccctgctgaattacttagttctggcagttttatttaaaaaaaaaaaaaaaaaagaggttccttaggattttctgtgtagaccatcatgttacctgcaaataaagatggttttatttcttcctttccaatctgtttactttttatttcttttcttgccttattctagtagctaaaatgtcttgtagtatgtcaaatagcagtggagagagcagacatcattgtcttgttcccaatcttaggcggaaggctttcagtctttcaatatattaagtatgatattaactatagggtttttcatagatattctttgtcaagttgaggaagttcacctctactcctaatgtgtggtagtttttttcataaatgggtattgaattttgtcaactgaaatgatccctatcaaatgatatgatcaggtgattttttttcttcttcagcctgttaatgttatagattacattgattgattttttttaatattgaacaagccttgcattgcttgagcaaacctgagtattagtcagcttgggctgccataacaaaatatcacaggctggatagcttaaacaacagaaatttatttctcaaagttctggagtctgaaagtcctagatcaaggtcttgcagagttcagttttggtgagggctctcttccttgcttgctaccttctcactgtgtgctcacatggcctttcccttatgaccttatttaagcttaattacctcctgtaggccttgtctccaaatacagtcacattgggggttaaattttgggggtgacacaattcagtccataacaccaagttgatcagggattatattatatttttatactgcttgatttgacttgcaaatatcttgttggaaatttttatgtctatgtatttttatgtcttatttttatgttcccgaggaatattgacctgtagtcttatatatataaaaataattatatataattaatgtatatatataaatttatatatttatatagatataaatttatatatatattaattatatattataattaatgtatatgttatatataattaatgtatatataaaaattacaaattataattaaatttgtaatttatatataatttatatataaaataattatatataatttatatatgttttatatataattttggtgacatacaccaaaattataaatttatatatatttataaatttatatatataaatttatttttatatatttatatttttatatataaatttattatatatataaatttataaattatttatatatataaataatgtgagagacagggtctcgctctgttgcccaggctggagtgcagtggcaccacctcaagctcagtacaacttccacctcctaggctcaagtgatcctcctgcctcagcctcctgagtagctgggattacaagtgttcatcgccacgcccagctgatttttgtattttttgtagagacagggtttcaccatgttgcccaggctggtctcaagctcctgacctcaagcagccctccagcattggcctcccaaagtgctgggattacaggcaggagccagtgcacccaacctctcatgatatttatatctgtattgtatcagggtagtactggtcttataaaattagttgggaaatattccttcctcttctagtttttggaagaaatggtatagaactggggttaattcttattaaaatgtttgatggaattctccaatgaaacactccagacctggaggcttctctttggggatttgcttaagtataaatttgagttcttttttttgtttgtttgtttgaggccttgctctgtcacccaggctgcagtgaaatggcacaatcacggctcactgcagcctcaacctcctaagcccaagcaatcttcccacctcagcctcccaagagctgggaccacaggcctgtgccgccatatgcggctaattttttaagaattttttgtagagatgaagtcttcctatgttggccagtctggtctgaaactcctgggctcaagtgatcctcccgcctcagcctaccaaaatgttgggattacgggcgtgagccactgcacatggcaaatttgagtcctttaatagataatttgaatagccctgtaactatttcatgttgagtgactttggttagtttgtagtttaaggtactggtttgtttcatctaagttgttgaatttacatgtatagaatggctcatagtattccctgtgttgctttcattttaaaattcaatcttggctagacttctacttccaaaaagatggagtaggtatgcttttccctatgcctcccactaagtacaattaaaaaccctgagcattttatataatgcaaacataagactttgaaagatcaggagaagaaagcagaacagctagagtccttgagacctgaggaacaacccagttttatgttccctgggatttctttttgttcccagagttggtgctggagaagctagcaacccagaagcacaaaccagcaaaaacaaaaaacaaaaactaagaaaagcctgtcctctctagccaaatgaccaggaaagggaccgcctatcagacaggaaaccttttttttattattttattatttttttgagactgaatctctgtcgcccaggctggagtgcaatggtgccatctctgcttactgcaaccttcgcctccctggttaaaatgattctcctgcctcagcctcccaagtagctgggattgcaggtgcacaccatcacacccagctaatttttgtatttttagtagaggtggggtttcaccacgttggccgggctggtctcaaactcttgacctcaagtgatccacccacttcggcctcccaaagggctgggattacaggtgtcaatcactgtgcctggccaacatggaaaacttttagacagaaaactcttctccagtcaaacaccacagaaaaatactttgggccaccccaaccttctccagcaaagatggagtagggagcttagacagcaatgatgtaccccatttggggttgtgttagaggagactgagtggacagtcaggattttcacctctgttcagcagtgtcagtggaggccatgcaggaaacaatagcaaggcattctcaccaatcccagtgatggaggtatccatggaagcctagtggggggctgaaactctcagccccacccaacagtaacagggatgttgacacaggccaaatggtgaactaggtcttatacaaccacctggtggtaacaaggcaatgcccccaaccctgatctccagccagatagtgtcataggaagccagccaaaatcgaaggtttgcataagatccagagtctcataatgccccaaatgtctaggttttagtaaaaaattactcatcaagaatcaggaaggtctcaacttgaccaaagacagatgccgacatcaagatgccagatattagaatagtttaacgaagattttaaaacagccaacataaaaatgcttcagtgaacaattgtgaacatacttgaaataagttaaaaaaaaatagtatccctctttcattcctattattggcaatttttgtattatctttttttcttgctataggttggtcagttatcttgatcatttcacagaacactcttcttatttttgtttgtttttagagacagggtcttactctgtcactcacgctggagtacagtggcatgatcacagctcactacagcctggaccttttgggctcaagtgatcctcctgcctcagcctcctaagtagctgggactacaggcgcatgccaccacgccaggctaatttttgtagttttttttttttttttttttttagagacaggggtttcgccatgttgcccaggctggtcttgaactcccgggctcaagcaatccgaccacctcggcctcccaaagtgctgggattacaagtgtgagccaatgcgcccagcccattacttttctgtttttaatctcattgattcctggtctttattatttttatccttctgcttactttgggtttattttgcttttttctcgtttctagtgttgagaacttaatttattgatttgaagctgtttctcttatctaatgtaagcatgtagtactataaattttcctctcagcacctgctttaactgtgtctcataaattttgatatgttgaatttcattttcgttctcttaagtatatatttttttaacttctcttgaaatttcttctttcacccatggattatttcaaagtgtgatttttggtttccaggtgtttggaggttttcttgttatctttctgttgctgatttctagttttctttttttttttcttttcttttaagagatgagatctcactatattgtccaggctggtctcgaactcctgggctcaagcaatcctcccaccttgacctcccaaagtgctgggattatgggtgtgagccactgcgcgtggccagtttctagttttgattccactgtgatcagaaaacacactctatataattccagttatttaaatttgttgaggtttattttatggcccaggatatggtctgtcatggtacatgttccatgggtgcttaaaaataagtgtatgctgctcttgttgggtagagtattccataaatgtcaattcgttcaactctgttagttggtggtagtgttgagttcttctgtacccttgttgattttctgtttgttggttctatcaattattgagagaggttgaggtctatagctataatcatggatttgtccatttccactttgagttcagttcatttttgcttcacgttttggagcactgttgtttggtgcacacacatttatgattgctatgtcttcttgatgacacttttatcattatataatattcctcttcatctctggtaattttctttactatgcagtctactttatctgatgttagtatagtcacttttgctttcttttgagtgatgtttgcatcatatgtctttctccattattttactttcaacctacttatatccttatattttaagtatgttttatttagacagcatatatttggatcatatttttaaatctgctgtatcaatctgtcttttaattggtttagaccacttatatttgatgcaattattaatatgttaggacttcagcgtgtccttttattttgtgtgtgtgtgtgtgtgtgtgtgtgtgtgtgtgtgtgtgtgtgtgtgttctctgtttttcatttctctgttttatttttcctaccttccttggaggttccctgaacaaactaccaaactcgatccatgtgaaatagatcatttgaatagccccaaagctattagtaacattgaatttgtaattaaaaacttcccctaaaaatacctccaggcccagatggtttcactgagaattctaccaaacattgaaagaaataacaagtgataacagtagaagagaaatttgaatcaaagatgaatagagttataaaagaaatagctaaccatgggaatatggggatatgctgctgttttagaagctctaggtttacagccaaaaagaacttagtgaaggcaaacttatcaacataaatgaagaaaatggttatggtgaaaagaatgaagatgtcccagaggaagtgatactagtgaaaaagtgcacattaaaggaattcttggaagtattttacaacattgaaggtacaaagaacaaaatgttgaaaactaatccacacttagaagggaatatgacaatttgccaaggggtagaaaaggtgcttgctccatgttgtaagttatgcaatgaaaaggagttaagcattgtaatcttgataagtttttacaaataaataaaagtgtaattctcaatgtttctagtgtttcaaattatattatattaaatacatattggttttattattttttatttcactatatgtttatagtcaatgggaagatagctttttaatgttttgacaaaatttttaaaggtcattaatgacagttttccccattgtttattaagattgcttttcacagttttagcttgcacagtcatttttacagtatcataccaccatgcaaagcaaggactatctgtaatctttagtgacagaaagcagatcattggttttctgggaggagacagggaagcaggaggatacaaggaaacttttgggggtgatggacacattatcttggttgtgatgctagttgtacaaatgtatgtagatgtgtgtgtcaaaactttatacatttaagatatatacagtttattgtatacccaaatcatgtatatgatgaatataatacttttatattcatatatacacatagatacattataagtatatgaacaatcatcacaagtagagatgagtatatgtatagatgggtaagaaaatgtgatagtggggtcgagtgtagtggctcacacctgtaatcccagcactttgggaagccaaggcgggaggattacttgagcccaggagttcaagaccagcttgggcaacatagtgagacctcgtctctacaaaaagtaaaaaaattagctgggcatggtggcatgcgcctgtagtggagctgctcgggaggccgagttggaaggatcgcttgagcctaggaggttgaggctgcagtgagccactgcaggctgcagagagtaccactacactccagcctagataacagagcaagaccctgtctcaaaaagaaatgtgatagtggctacatgaagacacaatcatgggtggttagaaaaggagaaagacaagatgtgactgtaaactacctaagggcagaacccctactgttcagataaaaaggttttcagtaaatatgtgttgtaaggagaataggaaaagaaaacaaagaggaaaatggtggatgttaattaagaaaatttgagaagggccaaaatataagtcagaaaaacaaagatgagaacaggaggaaactaagccttccattttcaccatttgcattcctttcttttttttttttttcttttcatttttgagacaggatcttactctcttgcccaggctggagcatggtggcacaatcacagctcactgcagcctcgacctcccaggttcaagggatcctctcacctcagccttccaagtagctaggactacaggcgcacaccaccgtacctggctaatttttgtatcttttgtagagatgggatctccttgtgttgcccaggctggtctcgaactcccaggctcaagcaattctcccacctcggcctcccaaaataccgggattacaggtgtgaaccactatgcctggcccacttgcctttcttatactaaaataaaaagatttttttggccgggcatctcaaaaaaaaaaaagattttttcactttctcaagtgcttgattgaaagagtttaatgtaagtagacataacattacaactaataagtgatgttttaaatcaaaataggggaatgggaggtagggaaattttactaagttcctcagtcagatcaagttttaagtttgtcacatgacctctgtggttttcataaatgtgcagcttgcttttcttagatttttttaagtgagataattcacctattataaatttttatttttatttatttattttgagacggagtttcgctcttgttgcccaggctggagtgcaatggtgcgatctaggctcaccacaacctccgtctccccagttcaaccgattctcctgcctcagcctcccgagtagctgagattacaggcatgtgccaccacaactggctaattttgtagttttagtagagacagggtttctccatgttggtcaggctggtctcgaactcccgacctcaggtgatccgcctggcttggctgggattacaggcgtgagccaccgcgcccggccatgtaaatttttaaatcaagatagaattcacataccataaaattcacccttttaaattatatggtggtttttagtatattcacagagttatacaatcatcatccctgtgtaattccaaaacgtttttatcaccctagaaagaaatcccacatctgttagcagttactagtcattctccgcttcccccagcccctggcaaccactgtattagtctgctagggctgccataacaaaataccacagactgggtggcttaaagaacaaaaatttggactttttcagacgtttctctttctctctctctccctctctttctctctcaaaaaaaaattattttttcatagttctagagtctagaaatccaagatcaaggtgtcatcagggttgacgtctggtgaggcctctcttcctagtgtgtaaacagccaccttctcactgtgtcctcacatggcctttcttctgtacgtgcacagtttgtgggggtggagctctggggtgtctccttctaaggacaccagccctatcagactaaggccccatccttatgacctctcataacctttattacctacttataggccctgtctccaaataaagtcacatcatgggttaggtcttcaacatgaatttgagaagggcctattgagttcataacaaccactagtctgctttctgttcttatggaactgcccactctggacatttcatataaatggaatcatacaatgtatggcattttgagtctgacttttttcatgtagcataatgttttggaagttcatccgtgttatatgtatcagtattcattacttttatgaccaaataatattctgttatatggatacaccacattttgttaatcctttcagcagttgatggatatttgggttgtttccacatatgggctgttacgaataatggtgctataaacatcctcatacagtttttttttaaattttaatcaggtcctctagaagaaaattcatacaggtttttgagtgcacatatgttttcatttctcttgggtacatacctaggaatagaattattgagtcatatggtaactctatctttaacattttgaggaattgtcaaactattttttatagcatctgcaacattttacattcctgtcagtaatgtgtgaaggttacattttctccacatcctcaccaatacttgttattgtctgtctttttgttatagcctttctagtgggtatgaagtgtatttcactgtgattatgatttgcatttgtctaatggctaatgatgttgaacagcttttctcgatgtccttcttagccatttatatatcttttgaagagaccttttctactttatcacacaaaaaagcctttatgaggtcagaaaacacaagattttatctttgtcttctatgaaatgctgctgttcacacagccagaatgagtcgtcttaagtcccatcacattcatttgagtatgtatgtccttggctgctgaaaatctgaccctttaatgaatagggcagcaaagttccctgaccatcagtgttctagaatgtcccattttttaatactgcatccatgcacacctcctatgttgtctttggagaaattattcagatccttaactcaatttttttaaacgggcagtctttttattgagtcataagagttctttacatattctggatacaagtctcttatcagaaatatgatttgcaaatattttctcccattctattgattctctttttactttcctcatggtgtcctttgaggaacgacagtttttaattttgggccaggtgcagtgactcacacctgtaatcccaacactttgggaggctgaggtgggaggatggcttgaaaccaggatctcaaggccatactaggcaacatagcaagtcctcatctctacaaaaaataaaaaattagctagccatggtggcgcatacctatagtcccagctgttcaagagacttacgtggaaggattgcttgagcccaggagtttaaggctgcagtgacctatgatcacaccactgcactccagcctgggtgacagagtgagaccctgcctcaaaaaaaaaagtttttaattgtgatgaagtccagtttatctgtttttttttttgttgttgttgttgttgcttgtccttttgatgttatatccaagaaatagcaaatattgcctaagccaaggtcaagaagttttatacctatattttcttctaagaattttatagtttggctattacatttaggtctttgatccatttgaattcatttttgtatctggcttgaggtattaggggtccaagttcatttttttttatgtgtggatatctagttgtcacaacaccatttgttgggtagcttcctttttgaaaatgatgaacactgtaccccaaacccacctaccttggttccatgtattccttataagtcaggctgctatgaaagaaagcatagttattgaattagcaagaaatcctagttttatattttgaaatcttagttcttttttcagagacagcgtctcgttctctgttgcccagcctggaatgcagtggcacaatcatagctcactgtaatcttgaactcctgggctcaagcaatcctcctgccttagcctccccaattagttgggactacaggcacatgccactgtacccagttattttttattatttttttagagatgggatctcgctatgttgcccaggctggtctcaaactcctggcctcaagcagttatcccatcttggcttcccaaagtgctaagattacaaacatgagccactgcacccagccagttttatttttttaatctcctgtttcacagatctaccaaagtgacttaaaatttttttatctagtttgagatgctaatttctgtactttatgcttcactctgtccaaatataagggaactttttaaaagttaatggaataatggaattaagtgatgaaaattaaaaatataaacttcatttctcaacgtaagctccatcaaggtcaagacacttttgtaagcaatgataccagccatttagttcttccctagagaactgagcgtcctgggaatttaaccatgtcagtgcagtcttttttgcattattaactgaaggaaaatgggtacccttaaagattttttaatattaggacacaaaaagaagtcagaaggaggcaaaacaggaccgtaaggtggatgcttaatgatttcccattgaaactctcacaaaattactcttgtttgatgagaagaatgaactggagcattgttgtgatagcaaaagacgttctggtaaagctttcttgagcagttttctgtaaagctttggctaactctctcaaaacactcataataagcagatgttatcattctttggccctccaaaaagtcaacaagcaaaatgccttgaacatccccaaaaactgttgccatgacctttactcttgactgacccacttttgctttgactgggccactgccgcctcttggtagccattgttttgaatgtgctttgtcttcaggattgtactcataaagccatgtttcatctcctattataattcttcaaagaaatgcttcaggatcttgatcccacttgtttaaaatttccattgaaagctctgcacttgtctgtagctgatctggctgtaaccagtttcagcacccattgagtgaaaggtttgcttaactttaatttttcagtcagaattgtgactgaagaactgtgactgtatgctgaaccagttgagatgtctgtggtgttggctgttgtttgtgctgttaatcatcagtcctctttaattagggcatgaacaagatgaattttttccttgcaaattgatgagatgtaaaaatgatgtgaatgtgggctttatcttcaactttgtctcttcccttcttaaaacaagctatccatttgtaaactgctgatttctttggggcattgtccccatgaactttttgtaaaacagcgatttctcctttcttctacccagatttcaccataaatttgatgtttgttcttgcttcagttttagccaaattcctattgctctaataggggcccttttcaaactgatgtcttatccttcttagtgcctgtaaaagttagtatgaatttatttttgtgtaaatttttgaaatctacatatagttttttattttccatgaactttttgaagacctcttatatgttactgttttcccaccctacatgacaaaacagcattatgttaatttttattggttaattttataacttttgtgttagttttccttttgtgtattttaaacagtttttgaaattaaaaatagctttattctcaaaaaccataaataaaaatgttctcttccaatgtaattgccaagtttaaataaatgtaagtgttctataacaaacccttgcaataattatttttagatttaaaactcttatcttcagtgattatgtattactatgttaataattgttgaattgtaaaaattatctccaccttccaaattttaaaaattgtaagtcagagtgcattgaaagcatgatgacattccttaattctgcactgaaggtttttaataaagaatgttatagcaattcacaataacatgtggaaagtatcagaatgtaaaaacaaaaaattatgaatatattattttgggcttgctacttcatattagttttggtaaaattaaaacccaattggttagtttctgctgatggaaatctcacttctatggagaaaatatt[138 bp omitted]atggtaaaaccccatctctaccaaaaatacaaaaaaattagctgggtgtggtggcttatgcctgtaatcccagctactcgggaggctgaggcatgagaatcgcttgaacctgggaaacagaggttgcagtgagccaagattgtgccactgcactccaccctgagtgacagagcaagactgtctcaaaaaaaaaaaaaaggaattgatctaatgtaatacaatagtaaattaagttaaaatgtacttgaaaatatttggaaataattattatgtattgggatacgccatttgttatagcaaacatcctcaaaagtctcagcatctttttttttttttttttttttgagacaggatctctgtcacttgggctggagtgcagtggcatgatcatagctcactgcagcctcgatctcccaggctcaagagatcctcctatctcagcctcctgagtagctgggactacagacgtgagccactgcacccaaccagtctcagcatcttaatacaatgaagtctttatttttcgcacatgtctccatccaatgtgggtttgaatgtggatcccctctgccccacacagttatttagggacacaagctctttttatgaatggcgcttttatttactacccattctcttttctactctctaacttctcaatccagtcagcatgaaaagagtggagggttatacagttggggtttttttctggtgggggcagcgggggtaggctttgaagtgacttacctacctacatatcattagccagaactcactcctgtggcccacctaacagcaaagggggctggagaacgcagtcttgctatgtgtgcaggtggaaatggaaatagggtttggtgaacacctcgcacttctctgctgctctttgatagtggcattacaaagtcaaagctatgagatcacaggaaccttattggttttattcaccactgtaaccctgtagttgatgctatggtctacactgcacagatttccatatagtcttaggatctttccacctagtgtctcagcaggatagtctgacttcttacagacagttcaggactccaagagtgaatgttttaagaggtaagaagtggaaggtgctcatttcaaagcctaggctcagaaactgacacagtattacttgcactatattttattagagcagttgcagagggcttccaaattgaaggaaaggaaaataggccccatttctcaataaaaggcatatcaaaggatttgtggccgtctttgatctaccacgtcataatatttttaatgtttgtctttttttttttttttaagagacagatcttgctatgttgctcaggctagattcaaactcctgggctcaagctatcctcccgcctcagcctcgtgatgagctggaactacaggcacaagctaccatgcctgtcttgagttacttgttttgttgcctatagacagattagtcagctagagaaactttactaataagactaaagtacactcttgctttttatttattaactaatttataaggttatcaaaatgctttagcatcttatttcctaatggacttagagcagtaattttggatatatgtataaattaattgacatgatccttgggtgctagaattactctactcgagctatagtaactgaaaatggatgagggagaaataagaatagatagagcacatcctttcagaatctttgttctggctttcagatgaggttttcccatctgtttcactgtcctttctgcagtttccctgttagttcagtatagtgtatatatgtggtgattgaggggaggggtacagagattacagagccatcttgcactgtaagttatagctgcttaggtaagtactgatgaccaaaagaaatttttcgacagtgagttcaacaaataaagatggtgttaaccctatttacatgtctctaggtagactgaaggattttgagtcattaacagtgagcttcagatatttctttttgggtattcatttatatattttaatcagtttctattgcagtaagattccaatagaaggaaaacaatgcttcattttttgttgaaagcaaacatacattataagttgtataatacacaatgattaatgaagttttactgtgtgtgtgtgcatgtgtgtatgtttttaaaattacggatgaactatcatacaaataaaaacaatcagaatacaaaaaaattaactgtgtagtgtatgcttatacacatgcatatatgtatatataaatgggattgttctataacttgcttttttcacttaatatatacttctgcatcgttaataaaactgaaagaggaaatgattggatatagataggtccctatttccccttgcaatgtaaactctggacttactgggctatggagatcagtgctttctttactaaactctagactcaaatatacaactgtcaattcaacagttccacttggatgtccagtagacatctcagactaaaaatgtcccaaactgaactactgatcttcccaaaccagttctatttgtagttctctagctttagctgatagaaaaatctatccttctagctgtaactctgtcttttcagtttaagccaaaattcttagtcatctttgattcttcattgtcttatatcccatattcaatataacaggatatcccattaactctactttcaaaatatatccatatttcatatagtaaaagaacaacccctaatgataaatggaaacacatgcctgcctcccactccactgctgtatttggtcatctaggcccctcccatctccccttactctcctcaccccatctccttcttcccacacctccttcttcccacacctcctttttcatcccattttaggcagcagcattctatcacttttactttcaattatgagaattcagtaaggagcacaa[145 bp omitted]gactacaggcacctgccacc[174 bp omitted]ttaaaatttaaaacagtccttttgcagttttccagttactattgctgatgataatttgcccccaaacttagcagcttagagcagctgtgttatacccattgattctgtgggtcaggaaatcagatagggcacagtggagatggcttccctctgctccatgatgtgtctagggcctcatcaaggaagacaaagtttgagagtgacccaacagctgggcactggaatcaactgaaggcttattcactgcgtgtctgtgtaacagcccatccctgggcttggataacatagactacacatggcctttccattagtttggcttcctcatagcctaacaacctcagcatagtcagatttcttacaggagtcaggcacagggctccaagtgcatgcgttcctgcaaaccaggagggagctacattccattttatgacccagccttgcagttctcatggcatcacttctattgatcaaaaaccatcacaagccctcccctatttaaggggaagggagatagacttcactacttgatgaagatgacaaagtcacattgcagaagaatgtgggatttggaaaataccatctgtcgcaggggttatcattgtcctttgttttgagtcatggagacttggagagaagtgattatcccagagtggtaggatgaacaagggtcatcttgggaaatgattcctagagttgttattacagtaactactatctagttagttttatttgtgtgtttagagatagggtcgcactctgtcacccaggctggagtgcagtggtgtaatcatagctctctacagcctcaaattcctgggctcaagtgatcttcctgcctcagcctcctgagtagctgggactataggaacataccaccacacccaactctatctagttcatttttaaggcatttatttcaaacctttacaaaacctatgaggttttggttttatgcagtttctgcagtgttcacaaatgattctaatccacttattaggaaatgtagcatagtctgtacctgccaaatatttagatcaactgaagagacactgaggggtctctgtacataagacactggaggaggccatagatcaggttagagtgactgcagttacctttttattgcctccttagttggcacagcagtatccacaaaggccagaggtagtagtgttccagccactggtctcccctggagagcagatgtgattgtgggtcctttcaccaaaggctagtcatctggaaagttattacaacattcatttacatgcaagcatccaaattgaaagttgaggttacctcatcctaacaaaattgctcatgcttctgggcttgcgagcttttgctgatttggtcaatggtctagtgaccatttaaagagtatcaggccgggcgcggtggctcacgcctgtaatcccaccactttgggaggctgaggcaggtggatcacctgaggtcaggagtttgagaccagcctggccaacatggtgaaaccccatctctgctaaaaatacaaaaattagcctggcatggtggcatgcacctgtaatcccagctacttgggaggctgaggcaggagaatcatttcaacctggtaggcagaggttacagtaagctgtgatcatgccactgcactctagcctgggcaacagagtgagacttggtctcaaaaaaaaaaaaaaagtgtgtctatccatagtacatagccaagaaagaaaatcacccatccagggaggataatcctgggatttcctccagctttagccatgttatatatactcgaagatattgaagctgcatttaaaaaatcccaaacatattttttttcactaattctcacagcccttccccctctatcattataagtacaataatttctccttgtgagtttatattaacttcatcttttacccatgtattttcttgtagttggtgttactgttttagtatataatttattgtcatggtcttggtccttagatgcagacctttagttcaagatacacgaggaaagatgagtgagatgacattgctgtcattatcattattgtaaattttgcatcgaagtataatatccacacagaaaagtacacaaagctgtacagctgaatgaattttcacaaattaaatgcactcatttatctgccacccagatggggaaataaaacatggctgggcacggtggctcatgcctgtaataccagcactttgcaaggccaagatgggagtatcacttgagcccaggagttcaagactagcctgggcaacacagtgagaccccatctctacaaaagattttaaaactagccatcgtggtggtgtgtacctgtagtttcagctacttaggaggctgaggtggcaggatcacttgagcccaggaggttgaggctgcaggagctttggtcatgccactgagaactacctaaaaaaaaaaaagaaaatattaccaacacccaagaacccctccttcttctccctgccagtaactgacctccctcacccaaggtatcagttttgccagtttttgagcttcctatgaatagactcctacagtgtagtcatttgagactgaattgttttgctcatcagtaggattttgccatccatccatcctgttgcatgtagtaattcattaattttcacttctgtgtcatgcattgtgtgaatatgccacattttttattctgctcttgatatatatttgggttgtttccagtttttacctaccataaaaatgctgatatgagcctttttatttatcatttggcatgcatctgtgtacacttttgctaagtatatacctagtgtgggtttgctaggtcatgggtatgtgtacgttcagctataatatctgctgccaaagtggttgttcaaattcacactcccaccagcagcataagagataatctatttgctccatttccttaccaacatttagtattttcaatttttggacagtctttttaagtttaattattctggtagataatagtgattgtaatttcagtttgcatttccgtgataactaatgaggttgagaaccttttaaaagtttatttgccatctggatagccttacttgtgaagtatctctttaagtttttttgcccagcttttaattgggttgtctttttctaattaatttgtaagagtttattatatattgtagatgtaagtcctttgttgtctatgtgcaattgcaaatatcttctcctgtcccatggattgcctttttattctcttaattgtctcttttgataaccagaagttctagtttcatttttcagtctcttcctttatggttaatggcttttgtgtcttatttaaaatatctttgcctgccccaaggtcataaatatattctcctctgttttcttccagaagcttaatgagcatattggtatagaaaaacatttatagcctaccttgttccatgtagaatttgaggcgattgagatgaatagttagcaaaacggtcttccttttagaagaagataactcttgacaaaaaattgggtattctcccttctaggccatgcactaaagaaacatgacatatttaatctcatagtctctaaagaattcatatgtctgtcctaccctttttagttgggtatgtttcagttggaagcaggcctctaacagcaattcccaaaattttagtttcaattagtatttgaggtttctgcatttttcctcaaatatttgttccctttggctttaaaaactccatatagtagaaaaattaaaatgtgcaaatgtgtgtcgttgttattagctttattcaggttcattatttggaatcaggcttttggaagaatgcttattaggaggcagtattctctacatttatagggtggactatgcctgtatatattttatgtttattcattggaatatgtttgtgtttgtaaatccttccatatatgtgatgactctagagtaaagaaactggctctagaagccttccggagaaatgattttcattattttatgatgacatacgtgtgtttatttctttttttagatggaccaccttgttctttaaaattgccacagaataataatccagatttttctcttggttaaattttctgaggcctcatacagtatttaaaccaccaataataacttgttggcatgaaaaaaatttatttttttctctggtttccttgccttgagcccttggatgtcaggaagggtgaggggaaatatcagtctgcttgggcttagatttatggttgctattgtttatggttgggaaatggattgagtgtgcatagctccatggcctcttggctttaactcatttgcataaatagtgaaaataataaggaatataaaaacaataacaatgacgttattgagcatctatttttactgtacactaagccaaacactttctgtttttttctatataattgttataatagtcctacaaatttggcattttttcccttcaacttttaagttcaggggtacatgtgcaggatgtataggtttgttacataaataaacgtgtgccatggtcgtttgctgcacaaatcatcccatcaccaagctgttaagcctagcatgcattagctattcttcctgatgctctccctcccctcactgacaggcagcagtgtgtgttgttccccctaccatgtgttcatgtgttttcatcattcagctcccacttataagtgagaacatgcaggttttggttttctgttcctgcgttagtttgctgaggataatggcttccaactccatccatgtccctgcaaaggacatgatctcatttttttttggctgcctagtattccatggtgaatatgtaccacattttctttatccagtctatcattgatgggcatttaggttaattccatgtctttgctagatattatttttatcatatttaatgattgttatccttacattttagctaagaaaactgaaccttatataaagtaagtggccaggcacagtggctcacgcctgtaatcccagcgctttgggaggccaaggtgggcggatcatgaggtcaggagttcgagaccagcctggccaacatggtgaaaccccttctctactaaaaatacaaaaaattagctgggcgtggtggcacttgcctgtaatcccagctactgggaggctgaggcaggagaatcacttgaacccgggaggcggaggttgcagtgagccgagaccatgccactgcactctaccctgggcaacagagcaagactccatctcaaaataaatgaataaacaaacaaacaaataaagtaatagcctgagatcaccatgtaagtgagtgacagaaaaaaacaagcctctgtgagactaaagcttgttttctttaccaccatccagtattgtctccgtgacagaaaattattaatttggctgaaatatatctttggtatgggatctggctgtgcctttgtgcagatatcgccccctcccaggttggtttcctcttctaaataaacttggtggccattgtaccaagaacacactaatgtgacgacattttattagaatgaatgggccagtcgtggtggctcacgccagtaatcccaacactttaggaggccaagttagaaggattgcttaaggccaggaattcaagaccagcctggacaacatagtgagaccccatctcttacccaaaaaaaaatttttcaaacgttagccaggcatggtggcatgtgcctgtagtctcagctacttgagaagctgaggcaggaggatcactggagcccaggagttcaaggctatggtaagctatgaccttgccactgcattccagcctgggtggttgagcaagagcttgtctctaaaaatttttttaaaaattagaatgttgggaaccaggatccatgagggtgaataaagaatattgtaagcagtcagtgagttaacagcacatgacaaaactaaatttgtaaaaccatttgctttctagaaaggaatctgccatacctcccagagggcatttagccatccattcagtgcctgaaatctgtcatttgttgattgttatcattgtctttctgttgcttttctaggattatagctgagaaggtaaaggacgttctgtttatccgaccccggaagtatattcactgctccagcccagacaccacagagcctggctacatcaacatcatggagttggcagcatctgtttgccgctatgacctagatgacatggacatcttctggcttcaggaactcaatgaagaccttgcagaaatgggtaagttcttttctcacaagtaagttgtgacttaattcatgttttttttttaagttatcagaaccctttagcttgtttttatttttgttgcctcctttcttttctggccttttcatttatttttctcattgattttatcttatttcagtgagatatttcttcaaatgcatacatagaaataaagcaataatatttaaatatgaccttttctttcctcattcatagttaatggcacagatcaaggatagcatataggtctcatgaagttgtttcccaattcaggaagtttgagaatggccatagctgattggccatagctgattggacttctggttgagaattctgaggcaggttcctggcctgaaaagcagtgtgatcagtgagcagggccagaggtagaggcccctctggcaggggcttggagagaatctccaacttcagtattgagcagcaccactgcaactgacagattgctgtgacagtaccccttaatgcaggacttgctacctggaagaaaagttgcaggcctagagcaaaacattcacaaagcagttcttagctacttccacggagttctagagttgtcatacaatattcaaaagataaaatgaaacaaaaacaagcaaataaatttatgtttacatatggaagtaaacataattaataattttaaagtaaatgtgtgccatacaataccataccaacaatactgagaaatgctaggctgaaagataactcattttatacttacacacagttcttgttcatctgttttcagtctaagcagtgttcacgtccaagttttcctgtagatctgtgggtagtttttaagactccgtataagatatggtgaaggatacatttgatctcatttttgtttgaatcacattttatttcatttttgtttgaatcacatttgttcattgttagtataaggatcagtggtttttcttttcttcccgccctccctttttcctttctttcttttgaggctagtatctgaatgcacatgaataaaaaactgaaattatattaaagcagtttggcatgggaatgatagttactctgccagtaaccaatccttattccttgatttttaaagctttttgttttatgtcttttcttgctctgccccctaagaggagaggggagtggtaaatttagggtggcaaccacaaagagaagggaatgaaagactgacagagaagtaaaatcagaatatgaggacataatcaaatggattcatggctcaatgtgcgcttgtgttcataatgcatataatatccatagctatcacaatcattgcaaggctgcctttggcatgaaactaccttattatgaggttcctttggtattttgtaattaattctccttgggtgagttttttaaataaactttttattttggaatagtttgatttacagaaaagttgcagttagtacagggagttctcatatacacctcacagtttcagttcccctaatgttaacatcttactttaccatggtacatatgtcaaaactacaaaaccaatactggtacattactgttaacttcagactttattgggatttcaaggtttttttttccacttacaacctttttctgttccaggatcccatcaagtataccacattgcatttaggcttgtaagaattttaaaagaggattgcagtatctcaagcttttctttagggtgaatgatattgcagtgaggtgtctaagagcttaaagtaaactttttaaaaacaatattaagcgtattatgaattaagaactttttaagttgagtgctgactacatattaagcaccatactaagcaatgtaccaatattacttcatctcagcttcacaacaaatcagtgggtttcttattattatactaatttcatagataagaacactaagccctaaagaggataaataacgtgtcaaagtttacatagctaatatgaggtaaggttggaattttaatccaagttttcttgtaaccagacactatattcctttactccaaaaaaaaaatgtgtaacttgtcttggctggaaaaatgaaacataaggcctgggcagtttttggtttcataagtagccacaccttaaaatggtagtttatgtggaattctaaagtttcttaggacatcttatattacaaatgaagtggaatacttgggtacatttgttttggatcatcttgaggattattccggagtttacaagttgttagaataaatacataagtgctgtcacaaaatttgattaataagtgtggaaggctaagataaagttatagctgagaaaaggaatcaggaagcaaagaaggtaattccagaattgaagttagacctttgtgaatattaacaggtttatatgttgttatagtttgccattgaaaaatattattagattttttaaaagtcatatttgaaaaacaaaatattttatatgtgtaatcacctacacatgggacctagaattttcttttatgggcttcatacatttttatatgaaaatttccttgtataatcattagatatgctcattgaagctaacttgctaagaatgaattattatatccaaatagttatgtgattttaattactatgctacaaattatcgtgtccagaattataaagcttggtgaaagtcctcctacagtgagaataagagaaaatatagagatttaagaggagactggcaaggatttggacaagaaatcgaaagggtcagtaatatatcttctaaggaacatggtgaaatatacatctcctttcatgtgtcaaacactaatatatgattataggtaaatgttagagtagcactagcaaaagattttttgaaatctggttgttttagagcaggaaagagatgtttttatcctttagaatcctacccactcctgcactgggctcacagtaggtgttttgggaatgacagctgactgatgggttgattgattgtttgtatttctgtgcaggttgtgggccagttgatgagaatcttatggaaaagacagtagaagtcctggaacgccattgccatgaaaatatgaaccatgctattgagacagaggaagggctaggcatagagtatgatgaagatgtgatctgtgatgtgtgccggtctccagacagtgaagaagggaatgatatggtgttctgtgataagtgtaacgtctgtgtgcatcaggttagtgagagtggagaccgtcatctccctacggtcagcctttctgaagctcagtgatgatctccagcacgcatatctgggtagcagcttgcatttaagggtgaaaataaagatttggcctggttgttcttcagtatttcctctagaaacaatgcttcttatgacccccaagatgacttgctgactaactttaccccatggggctaaacccaggtctttattgtgtcactttatgcccagaccattgggattgccttgttcagcttgcccctaggcccctgccccagggggatctcattgctgcctgtctgaggtctctcctcttccttcaaatctccatggcctcatgaggttacacccatggtcagtaaccttggtgagtttacacttcctacaaatagaagtccagactccttatcctggcacttgtaaccctcccccatcccctaaacatgccactcctaagaatgtccaccccacttttaaagatcacagaattttaggactgcaaaagactgtctaactcctcaattttacacaaataccgggagaggtgaagtgactttacccaagctggttatttgtcattctttctactatactgcctttttaattaataatgatgattatgatatcaaccctcctttcagctctttccattttttcccccacaagcactgtgttccaacaaaataaggttactcaaggtgcagtgatgaatattcctgacactgtcctatctcccatgtttcagccacactccaatttgtaaatgcctcctcctatgtcccagctatcaaaaatctatatatttttcaaggtctagttcaaatcctttcttgaactcccttaccctaagtgatttttcattcttctgaacctgttgtatatttcattcattttgttaatttgtctagcaaataggtacagtactccgtgggccaggattgtgatgcatgctgaggacacagtcagtgatgaagaggcagacatggtctgtgcccccagggagatcatagtctggtgaaagaaatataaggaaactgccaatttagcatcatatgccaagtgtttttatagatataagtccaagctgctgtggaaatgcatctgtgagaaacgagggtcagggacaacttccaggaggtagcacccaagctaaatcttaatgtccaaaaggagatgtcaagtaaaccagcaatgtgtgttcaggcagagaggagaaatgttcagacagggtagtgaaagcaggcaaaatatgtcagaggcaactgaagccttcagaaactgtaaagtggcagagtagagtagggaaggcatggaaagtgagggtagagagggatacaagagacgtgtgtaaaggaccgtctgacaaactaaggaacttcagttctgtcctgtcaaccctggaggatatgatatgtattttagaaagatcattctggctacaaaatgactaaagtaattagaatagataacatagcagatagaaaccagggcttaagattattttaattccctgggcctcttaacctaaccaccctgtatgtaaaaggtactcagaattattctgtgaccaattgggtctttttcttcatttacctttaacaaagtgaattttgaaaatttgtcttcactttaccaattattggcatttatatcagactttaagtgagagcagaaaatctttaccatttaactatgaacttaagtattatatctcacaatacaagcccagagtcctttctctgcaattccaaaattataaagttctgaaaaacgcatgtttttgctgaagtttcacaccagaactgatttgaggacaataccacaacccacccagtatgaggccatttgtagtccttatccattttgtttaaatactcatatattttgttagagaactattaatgtgtttggttatatggtattgcccctggtcccactgggggcttaggtcatatactatatatatatatatactttcctaagatctgagcaattctgaatttcctaatttttcttaccctagaggtttcagataaatgattgtggatctgtagtaggcttaaaaggaatagcataaaggtcatctgtatatatttcctatgtttgtcctttacagttgggacaaaatagtaagtattctcaggttctttaacaaactcaaatgtagcataattatctccaatgctatttattagtcttaaaaacgattccggtaatgaatataaatgatacccctttctcacatagaaagagatgagatggcaataactgaccagaccttgcagtatgtaaactggtatgtattaaagctgggacattggtaccctataaagtttcacataagagattcttccaaagtgagtatatttacttggattctaaagagatacttggcttagagctccctctgttggctgaaaagtgacttaaaataccttggaagatttggtttactccctaacagaatggggacatgttgacatctgaatttattaaacatgatttttcttctttagtgacaccatattacatttcagtgtttgttcctcagtgacaaaaaatacacttatgtgtactttagaagagatgtgtacataagtagcctttagattttaac[165 bp omitted]caaaaatgagctgggtgtggtggcatgcacctgtagtcccagctgctcgggaggctgagg[131 bp omitted]atccttttacatgtatctatgatcttatgactgtgagtaagtccacaaaagggctcagtaaatgatgttctgccctatagactggccaggagctaaaggatattccaagagccagtcactgacctgacctctcttctgccagtctgaaagagactctattttagggaggaagcttgctttcatttcctagcaaacattctgggcctcagacaaagagctttaaaggttagaaaccttataaaatgatgccttgctcttgtgagaggagcctacctagagtccagcttcagttcttgagctaaatacatttgttttatccaaccacctactcaagctcagcatagggggcattccaggtaaattgatgataacagctctacctctagtgactttaaaatctcattgagttctgtaggccagggttaattaaaagaaaaaaaaatactaaaaatgtcactgaggagaagaaacacaacagcaaatgtagagaaaaagaatacatgatgctggccgggtgctgtgactcacacctgtaattccagcactttgggagaccaaagtgtggatcacttgagcccaggattttgagagtagcctgggcagtattgcaaaacctcgtctctacaaaaattagctgggcagagtggcacatgcctgtgctcctaggtactcgggaggctaaggtaggacgattgcttgagcccaggaggttgaggctacagtgagccaagatcatgccacagcattccagcctgggtgacagagcaagaccctgtctcaaaaaaaataataataaaattaaagaacacatgatgctgactatgtacttggtgagggaaattgcatggagtggaggatgggagtcaggcagtgggacaaacgcaaggggctacagtgacctgagcaggatttttggaggggcctggagtttgaaccgggtctggaagggtgagaaaggtccaactatgcaaacaacagttgaccatgtagagcagggaagctgcttagacacatggatgtgaaaataagaatgaccagttatggagaaaaccaggaggcctgcctgtccaagtcagaagccctgtgtttgggtatagtggggcatgagatcagatagtgaagtacaaggaacaacaggctttagataaggaaccggcaaactttttctttaaggatccgctgtaaatatttcagtctttatagccacatacagtctctgttacatgttcttcttcttctctttacaaccctttaaaaatgtgaaaaccattcttagcttgttggctttataaaacagaccttggaaaatagccaacccctagtttggatagtggggagcaggtaagagcagaaggaatatctaaagggcttgccactgtacaatggtatgaattcttttagtgaggagaatctggcagtcaagtagaagaagggttgaaggcgtgcagggggaaaaagaaaatgtagaaattaatcaatccaggcatggcataatgagaacttggatagagcaagtggtgaggacggagaggaacgtcagagtcttggggccactgtagggagaatagcaagtaccaggtcagcagatgaaagaaagtgagtaatacaagtctaggaatttggatctggaagataggaagtatggtggtgacacggaaagaaggagcttggaaaaggaccaggttgtggggggaccgatattatggtaactgttataacttgaatctgagttgagggtgaatctcctgaggcagacagaaattttgaagctgccatattgaatcagttagtctctaatagagtagagcagtaaggaggaaatgatgggcaaaattggggatagcaaaaagggagtctagaatgtttcccaaactaatctccagtttctcacagtaattatttgtccaacttcattccataaaggatttgaagcaccttccagaactcattatgaattattgtgattagtgtaatattctattcaagattcattcacaagtccctgtttcttcaacccaagcaagcaattgctacgatttactgagtactttttatgcaccaggcgttaataggctttttataaacgtcagttcatttgctcctcagaagtttcattctctttattttctaaaacttttttcttgatcacaacagtgtatgacttttaggaaatgttcaataagtgtttgactaattataatacatagtcattgaagaagctttagaaaacagaccaaaaaatgctgtaatcacaacactcagataacagttgggttaacggttggctgtatctcctcgtcttgttctatcatccttaaagtcagttctcatggacagacatgctgatcttaggagagatgctggaagttgcttttttgagtatttttaaatcactcgatactggatataagcttgttcggctttatttgcctttctcccaaaagcagaggatactctgtgactgtgtatcagaacagataccaaccctggtgagaaggtgctgaccattctcccctctcctcctcatacctccaggcctgctatggcatcctcaaggtcccagaaggcagctggctgtgtcgctcctgtgtcctgggcatttatccgcaatgtgtgttatgtccaaagaaaggtggagccctgaagaccaccaagacagggactaaatgggctcatgtcagctgtgccctgtggatcccagaggtaagaattcatccaggcccgtgagaccatttgctccagggtgtccctgttccccacagcattcagactgactcaggctcagtatggaaatgcttcatgcttgcccatgtttctgaagtaatagtacttccacttgagctacctcagatccttattggatgcacacttgcatgtaagcccatggtgattaatatataggtggtattcccagtggtatttgggataatacccgaatatatacacgatatttgggataatacccaaatatatacatgatatttgggtatatcatgtataaattgataaatttgtatgagaggagagacacaaaagaccagggtgtgagcagcagaattttttaaggtaaaacttatatttagatgccaaattttaagtgtagagttttgtgatattttacacgtttgtatctgtaaccacaactcagaccaagacatgaaataccctaaaaatagacataaagcaccccagaaagatcctctatacccactttccagtctctatcccccaagaataaccaccatttttgtcttgatcatgatagattaattttatctggttttaaacttcatacagtatgtatttttttcggtctggctaacactccatgttgtggtgtatatcaatagtttattcctttctattgctaatattccattgtatggatatactctgatttattcattttcctttgatgggcatttgggttgtttacaggtttaggctattacaaataaagtgagcagtaactctttgtctactgtgatgatgccctttacttttttatttttatttattttattttatttttgagacagagtctcgctctgtcacccaggctggagtgcagtggcgctatctcggctcactgcaaacttcacctctcaggttcacgccattcttctgcctcagcctcccgagtagctgggactacaggtgcccgccaccatgcctggctaattttttttttttttttttggtatttttagtagagacggggtttcaccgt[137 bp omitted]ctcaacacctgccaaagaccttctttactcaaaattcaattttttatcattatctagcctggtccttcagttgctggtatttcctgagtggctacatgtacactaacttaattaaaatggggcttgaagacatttcttcttatggctgcctttttttttctttagctgtgtggatatcccactcatgccctctctccccagccactatccaaaccagcaaatttgttaggcagtttaactgcatgacaagagagactgcagaatctagttaatggggagctgacattatatcagtaactcattctcctttaagattttcttgtttttaatcttgttaatattggttccaggggagttattgtctaataaagaagctcagagttacactaaaagtcccatatatatacttttgtattcctatggctatagacatcagtattttaaaaaaatatttgaatagtagtttctttttctcactaagaacatctagacataaaataaactcaggtttctggcttgagaatgactgttttccaacagcaaatccctcagctaatagagtaggctctctcagcttataaaagtccagaacatgactcaggaagagctctttaaaaacaaaatagactttctcagttattgacattctcttatgatttctagttcttggtttccagtgccttctggactactcaagatctgttagtttcctgatgtgggcagaaccagtactagtttggcatccttatttgacagttcttcaccttttaaagctgtatctctcttagaaactcatgtatatatttggcggggtggggggaatgaaaatactttttaccagcagttgcttgaccccttattttcacatggaaaagaatatttccatctttttaaaaaacatccctttctgctgggtgtggtgactcacgcctataatcccagcactttgggaggtcgaggcaggcagatcacttgagtccaggagtttgagaccagcctgggcaacatggcaaaaccccatctctactacaaatacaaaaaattagccaggtgtggtggtgcatgcctgtagtcccagatattcagggggctgaggcggcaggatcacttgagcctgggaggtcgaggctgcagtgagccctgatcctgccactgcactctagcctgggtgacagagtgagaccctgattcaaaaaggaaaacagaaaaagcatcccttttttgatggggttgtttgtttttttcttgtaaatttggttgagttcattgtagattctggatattagccctttgtcagatgagtaggttgtgaaaattttctcccattttgtaggttgcctgttcactcatgaacagacacttctcaaaagaagacatttatgcagccaaaaaacacatgaaaaaatgctcatcatcactggccatcagagaaatgcaaatcaaaaccacgatgagataccatctcacaccagttagaatggcaatcattaaaaaagtcaggaaacaacaggtgctggagaggatgtggagaaataggaacacttttacactgttggtgggactgtaaactagttcaaccattgtggaagtcagtgtggcgattcctcagggatctagaagtagaaataccatttgacccagccatcccattactgggtatatacccaaaggactataaatcttgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtagggggaggggggagggatagcattgggagatatacctaatgctagatgacgagttggtgggtgcagcgcaccagcatggcacatgtatacatctgtaactaacctgcacaatgtgcacatgtaccctaaaacttaaagtataataaaaaaaaaaaggaaaaaaaaaaagcatccctttcttttcagcactctcccaaagacttaatttcactttgaagctactttggctgagggagtagggtaagctcatgatagttatgtggttttaaagacttttgttttaaaatgtcatcctcctcctttctacttacattctgcagtctcttcattacacggatgtgctgtttttcaacaatatcatggttcctttgtaaatcaaatggaaagacttgtcactccctctgttttttatccttagttgattaaatgaaacaacaaggcatgtagcaccatctcttaacataatagatactcgatttagttactttcagtagctttctttggttcctaagtaaaagtgtccattacggtaaccttggctgggcgcagtggctcatgcctgtaatcccagtactttgggaggccaaggcaggaggatcacttgaggccaggagttcaagaccagcctgaggtaacatagcaagacctggtctctacaaaaaaaataataataatttttaattttgtgggtacatattaggtgtatatatttacgggatgcatgagattttgatacaggcatgtaatgcctaataatgacatcatgaaacatggggtattcatccccttcaagcatttatcctttttgtgttacaaacaatccagttatgttcttgtagttatttttatatgtacagttaagttattttgactatagtcaccctgttgtgccatcaaatagtaggtcttattcattctttctgactatcctttttgtacccattaattatcgtcaccctcctcctgccctgttccccccactacccttcccaccctctggtaaccatcctcctacagtctatctccttgagttcagttgtttttatttttagatcccacaaataaatgagaacatgcaatgtgtgtctttctgtgcctggcttatttcacttgacgtaatgacctccagttctgtccacgttgttggaaatgacaggatttcgttcttttatatggttgaatagtactccattgtatatatgtaccacattttctttatccattcgtctgttgatggacacttagcttatttccaaatcttgactatcgtgaacattgctgcaaaaaatatgggagtgcagatacctctttgatataccgttttcctttcttttgggtatatacccaacagtgggattgctggataatatggtagctctattttttgtgttttttttagaatcctccaaactattctccatagtggttgtactaatttacattcccaccaacagtgtataaacatttccttttctccacagtgtttgagggttcccttttctccactcctcaccagcatttgttattgcctgtcatttagataaaagccaaaaatatttttttttaattagccaggtgtggtagaggctgtggtgggaggatcacttgaacccagcagttcaaggctgtagtaagccatgattgcaccactgaactctagcctgagtgacagagggagaccttgtctctaaaaaaaaaaaaaaaaaagaagaaagaaagaaagaaaagtaaaaggtaatcatgcctagtctatactcctgctctctcatcccatatgtgaattatttacattactggaaatgagtgaaggactgagcagtggaaataagttttgtttattcttgattccatattaaccttaagagatgtgacttacctcattgttttgatgttcttagctttatgtaacatcgtttatggtttgtgaaaggtacttctgggatgccttggtacttctgccttatggtggtattttatttgtaggtcagcattgcttgtcctgagaggatggaaccgatcacgaagatctcccacatcccacccagtcggtgggccttagtctgcaacttgtgcaagttgaagacgggggcttgtattcaggtaagtccccatgagaagtggtagagtgggctaacaccaaattagctggactcaccctcccagtgagagtgtcctgtcgactgaaaggtcactcaggagatcgcccacccactcttagggctctgccattgtacggaccatttctggaaatcccttttttggatattgcctctggaccattcagcttattcttttcaatattcgtagtgatagtttatcttcatcctttgctgtcagagctgatgaattaagtgagttctaaagctagttgataccatcctgggtggaaatcggctataattctgaaacaaccaggcccatgttcttttttttttttttaatttcaacttttattttcaattttggggttacatgtgcacatttgttacatgggtatattgtgtaatgctgaggtttgaaatacatttggttgtatcacccatatagtgagcatagtaagtacccaataggtagttttttaacccttgtactctccctcctccctctagtaatccccactgtctatttttcctgtctttatgtctgtgtatacccactgtttagctcccgtttgtaagtgagaacatgtggtatttggttttctgtttctgaattaatttgcttagaataatggcctccagctgcacccatgttgctgcaaaggacatgatttctttttttgttttttctgtctttccaacttttattttctgttcaagggtacatgtccaggtttgttacatgggtaaattgtgtgttgcagaggtttggtgtacagataattttctcacccaggtaatcagcataatacccaacaggtagtttttcaatcctaaccctcaagtaggccccaatgtctgttgttcccttctttgtgtccatgcctactcaatgtttagctccacttataagtgagaacatgcagtatatggttttctgcaattaggggagacgtggatgggattgggaagggccagttacctccagcaaaggcacaaaggttgctttctctttccatgttatttctccttctatcccaaatgtaataagatggctcttctggctagagggatggaagggctgacctttcacctctcagacctcctacatgtgaactgcaagctggttggagttatatttgcctgccgaccttctttggtgaagaggggacattgcacagtgcaggggtccgcaacctgccacagacaggtactggtccatggcctgttaggaaccgggccgcacagcaggagataagtggtgagcaagtgagcattaccacttgaactccgcctcctgtcagatcagcagtggcattagattctcataggagtgtgaaccgtgttgtgaactgcgcatgcgagggatctaggttgagcactccttatgagaatgtaatgcctgatgatctgtcaccgtctcccatcacccccagatgggatcgtctagttgcaggaaaacaagctcagggctcccactgattctacattatggtgagttgtatagttatttcattatatattacaatgtaataataatagaaataaagtgtacaataaatgtaatgtgcttgaatcatcccaaaaccatctccctccagtccatggaaaaattatctttcacaaaactggtccctggtgccaaaaaggctggggaccactggctttagggataatgactctaggtgctttgtgacatttcttgctgtctggcatgataatattttccaggcttatcgtgtagatttcttgctctagacctgggattagctattcttccaaggaacccagggtcttttactgggaagttgtaattgaagaacacaatctggacccccaaaggcccttttaattttttgaattcattcttatatttgacagaattggctacttcttcttttttttaacctttcttggatgattttatttattttaactatggcactttaaaaatcataaaggaaaaatatttaaaggaaaactctttccatggagactactaccctaggacattgcctgtgtgtttatctaagctctctcctggttgctgcccatgtgtgagtcccttgagggccaagattgtgcatcatttttctgtgaatttccctggcacaaagtagagagcctgcccattgttagtacttaattatggtttatcaaataaatacattcatgttttattgtaccatggattcatttgtgatatgcatttccccctctaaaaataatatatttttcatttttcagttattggtcattttatagtagcacattggatttatatccagtaacttattttctttattgtggtcactgtagtttcccccatttttgcttttgttgtgggacagggtctcactctgtcacctaggctggagtgcagtgacacaatcatagctcactgcagccttgaactcccgggctcaaatgatcctcccgagtagctgataccacaggtacacgccactacacctggctcatttaaaaaattttttttttgtagagacaggatttcgctgtgttgtccaggctggtctcgaactcctggcctcaagtgagcctcctgccttggccttccaatccaaagtgctgggattacaggcatgagcactgtgctcttttttttttttggtccgagtctctccttgttgcccaggcttgagtgcaatggcgcaatctcagctcactgcaacctctgcctcctgggttcaagtgattcccctgcctcagcctcccaagtagctgggattacaggcacacaccaccacacccagctaattttttgtatctttagtagagatgagatttcaccatgttggccaggctggtctcgaacctcaggtgatccactcgccttggcctcccaaagtgctgggattacaggcatgagccaccacacctggcctttttttttcttttctttctttttttcttttttttttaaagagagacagagccttgctttgtcacttaggctggagtgcagtggtgagatcatagctcactataaccttgaacttctgagctcaagcaatccttccacctcagtctcccaagtagctaggtctgtaggcacatgccaccatggctggctaatttttttgttttgtagagatagggtcttgctgtgttgcccaggcttatttttttctacaataattagtaattggcaataagactttggtgagagaaaatattggccttgaccttaacagacctggatttgtattacagccctgatgtaccacattctgccactattatggttatttatctatgagttttatctgccctagtagactgtaaacttagactttcatccttagatcccctatacccgaatctagtagacagacaattaatagattgatggatggatgatggatgaacagtttgagagatgaaacattctggtgtaagtttctcatttgcagagcaatgattcttactttcattacttgagttcagcttctttattttataaaggtcttaccaaattgagactcttacaattttgattataaggaatttcattacagagactcctctgcatgaggaaaggggaggaaacgtagaaaggactttgtcatacagcttgggtgccagctcagccacagtagaagaaagcatcagataagattcctaaggttcttgactccaggccttgggtcccagatagtatctctggacccacccaaggccaggaggaattcgccaccctgaaaggaaggacacaagccttgctggatttgccacctactgattgtagagcccttgggatgtgaacgaacataggtagtagccaggcagtgatcactgcaggccttgggcgagacccaatgctgtgctggctttagatctgactgggtgcagtcccagtggtggtggccataggggtgcttgtattagccctcctccatctccaggcaactcagcacagagagagacttcatttgtttagagggaagtaagggagaagaacaagaatctctgcctgttaatccagggagttcttccagatattacccagtaacaccaacgtagtatatctacaagtctgcaagagccatggcattactaggcttgcagtgcctcctaaagcagatatggccgtagtgaccaaagacttagatcacaacacccaagtccctctgaatacctggaaagtcttccgaagaaggatggatacaaacaagcccagactgcaaagactacaataaatgctgactcttcaatgcccagacactgatgaacatccacaagcatcaagaccatccaggaaaacatgacctcacaaaatgaactaaataaggcaacagtgattaatcctggagagacagatatataacctttcagatggaaaattcaatgtagctattttgaggaagctcagcaaaatccaagataacacagagaaggaattcagaatcccat[221 bp omitted]gaggcaggagaatagtgtgaacctgggaggcggagcttgcagtgagccaagatcatgccactgcactccagcctgggcgacagagtgagactctgtttcaaaaaaaaaaaaaaaagaaagaaataatggaaaagaatcaagcagaaattctggagctgaaaaatgcaattgacagactgaagaatacatcagagtctcttaacagcagacttaagcagaagaattagtgagcctgaagacaagctatttgaaaatgcacaatgagaggtgacaaaaggaaaaagaatgaagcatgcctacaagatgtagaaaatagcctcagaagggcaaatctaagaatgactggccttaaagaggaggtagagagagagatcagagtagaaagtttattcaaagggataataacagagaacttcccaaatgtagagaaatgtatatcaatattcaagtacaagaagattataaaacatcaagcatatttaactgaaataagactacctcaagacatgtaataatcaaactcccaaaggtcaaggataaagaaaggaccctaaaaacagcaagagaaaagaaacaaataacatacaatggagctccaatacatctagcagcagacttttcattggaaaccttacaggccaggagagagtggcatgacatattaaaagttttgaaggagaaaaacttttatcctagaatagtatatccagtgaaaatatcattcaaacgtgaaggagaaataaggactttcccaaataaacaaaagctgagggatttcatcaacaccaggcctgtcctacaaaaaatgttaaagggagttcttcagtcttgaaagaaaaggatgttaatggcaataagaaatcatctgaaggtgcaaaactcactggtaatagtacacagaaaaacatggaatattataatattgtaattgtggtatgaaaactcctatcttgaatagaaagactaaaagattagccagtcaaaaataataattacaacaacttttgaagacatggacagtataataagatgtaagtagaaacagcaaaaagttaaggggatgaagttgaagtgtagagtttttgttttctccttgcttctttgttaatttgtttatgcaatcagtgttaagttgtcatcagtttaaaataatgggttataagatattatccgcaaggcccatggtaaacctcaaatcaaaaacatacaacagatacacacaaaaataaaaagcaagaagttaagacataccacctgagaatatcaccttcactaaaaggaagacaagaacaaaagaaggaaggaagaaaagaccacaagacaaccagaaaacaaataaaatggcaggaataagtccttacttatcaataacattgaatgtaaatggacaaaactctccaaaagacacagagtggctgaatcaatacaaaaaacaaggcccaatgatctgttgcttacaggaaacatgcttcactatacatacacatataggctgaaaataaagggatggaaaaatatattccatgcaaatggaaatcaaaaagcaggagtagctatacttaatagaaaaaaactataaaaggagacaaaaagatcattatataatgataaaggattcagttcagcaagaagatagaacagttgtaaatatatatacacccaattctggagcaaccagaaatataaagcaaatattattagagttaaagagatagacctcaataaaataatagctagagactttaataccttgctttcagcattggacaaatcatccagataaaaaatgaagtatcagacttaatctgtactgtagaccaaatcaaccaagtagatatttacagaacatttcatccaacagctgcagaatatacattcttctcctcagcacatggagtattctcaaggatagaccatgtgtcaggtgccaaaacaagtcttaaaataatttttaaaaattgaaatcatcaattatcttctctggccacagtggaataaaactagaaatcaataacgaagaattttggaaactatacaaacacttagaaattaaacaacatgctcctgaacgaccagtaggtcaatgaaggaattaagaagaaaatttaaaactgtcttgaaacaaaaaaaaaaaaatgggaacacaacataccaaaacctatgggatatagcaaaagcagtactaagaggaaagtttataacaataagcatgtatatcaaaaaagtagaaaaacttcaaccttatgatgcatcttaaagaactagaaaaacgagcaaacaaaaccctaaattagtagaagaaaggaaatataaagatcagagcagaaataagtgaagttgaaatggaaaaaaaagatcaacaaaacaaaaagttggttttttgaaaagataaaatcaccaaacctttagcccaactcactgagaaaaaaaaagagagaaaccccaaataaataaaatcagagatgaaaaaggagacattgctactgatactgcagaaattcaaaggatcattagaggctgctatgagcaactatatatgccaacaaactggaaaacctagaagaagtgaacagattcctagacacatacaacctaccaagattgaaccatgatgaaatttaaaatctgaacggaccagtaacagatggtgagattgaagtcgttataaaaagtttcccttcaaagaaaatcctgggacccagtggcttctctactgaattttacaaaacatttaaagaagaactagtaccagtgttactcaaactattccaaaaaatagaagagaagggaatacttttaaactcattctacaaagccagtattaccctgataccaaaatcagacaaagacacatcaaaaaaagaaaactacaggccagtattctggatgaacattgatgcagaaatcctcaacaaagtactggaacaccaaatttaacaatactttgaaaagatcattcaccatgaccagtttattgagggtttttatcatgaaggatgttgaattttatcaaatgctttttcagcatcagttgaaacgatcatacggtttttgtccctcatgctgaagatacgatttttcacactgcttgatttgcatatgttgagccatccttgcatccctaggataaatcccacttggtcatgatgaatgattgttttaaaataactaaaagggtataattggattgtttgtaacataaaggataaatgcttgaggtgtgggatagaaattgaataacatagagtggctagaataaaaatcttgaaaaagaacaccagagactgatttaggaattaaggcatatcattcctctttgaagaaactttgggttggatgcagtggctcatacctaaaatcccagtgctttgggagcccgaggcaagaggattgtttaaagccagaagttcaagataagcctgggcacggaaactcttcttataaatgtggatttgtaaaaggtagcatttttcctctagtgaaagcatttgaaaaagtatttttcttctacaattcctgaagaatatgtagaaaattgtttttccagctgggcacggttgctcatgcctgtaatcccagcacttcgggaggccaaggtgagcagatcacctgaggccaggagttcaagaccagcctgaccaacttgatgaaactccgtctctactaaaaatacaaaaagtagttgggcatggtggcatgtgcctgtaatcccagctacttgggaggctgagacaggagaatcgcttgaacccaggagaggcagaggttgcggtgagccgagatcgcaccattgcactccagcctgggcaacaagagcgaaactccattacaaaaaaaaaaaaaaagtaaataaaccacagtgagataccatttcatacctactagggtggcagtaataagaaaggcaaacaatcaaggatgtgggaaaattggaaccctcatgcattgttggtggaagtaaaaacgatgcagctgctgtgaaaaaagtttggcagctcctcaaaatgttaaacatagagttaccttataaaccagtaattctactcctaagtatatactgcagtttaagagatcaccaagaccattctcaggttcagtaattcactagaaggactcacagaactcagaagaacagttatactcacagttatagtttattatagtgaaaagatacagatttaaaattagccaaggatagaggcacataaggcatggtccaggagagacctggaatgcagcttccagttacccctgccagtggagtggtgcagatagtgcttatttctcccagcagcaatgtataatacacatagagtattgctagccaggaaagctcacccttggtgttcagcgattttattgagagttggccacgtaggcattgctcaccatccacgtggctgatgttactctccagtccctccagaggtcaggctgatagaaggtgccccaaagtctctaccataaatcacatcgttagcatagactatctcacttggcccaaggacccaaggtaaacaaagacactcttatcaggcaggacattccaggggcttaaaggttacttctaaggagctaaagacaaacagccaaactttttttttagacaaggttatcctttaccgcacaatacccaagagaaacaaaaacatatatccacacaaaaactgctgcatgaattttcatagcaccattatttcataacagacaaaaagttaaaacaacccaaatgtccatcaactcgatgaaatggggtatatccatacaattattttttgcccataaaaaggaatgaagttataatacatgctacaacatagaggaacctgaagaacatgctaagtgaaagaagccagactcacacagccacatattgttgtaattccacttatatgaaatgtccagaataggcacatcaatagagacagaaagtagattagtagttgcttggggctggagttggtaacagggagtaactacaaatggacacaagatttggggttggtggtgatgaaaatatcctgggattaggtagtggcaatggttgcatgactgtaaatatattgaaaaccattgaaatgtacacattaaactggtgaactttatggtatataaaatatatcttaataaagctatttctgtcatttcagtgaatgaatataatgaccatgctgtaatgcacgtagtaaagtgtttaaagacacatgtataaaagatgctttgtacaagtgctatttgcttgccacaatgagaacagtgctatctcaattttttattttaaatttgtaaagataaaaatattttttaaatgggcataataaaacctctctatcaccttccgtggttacagtggaaataagtgagatgtatgcaaaggcattttgtttaatagaatgcgccagacatatgttttagaagaaaacaaataggtatctggtatctgactggc[137 bp omitted]cctcctgagtagctgggattacaggtgcccgcctgtaatttttagtagggatggggtttcaccatcttggccaggctggtcttgaactcctgacccatgatccaactgcctcagcctcccaaaatgctgggattataggcgtgagccaccgcgcccaaccctttttttttttcagggtctcactcctatcgcccaggccggagtgcagtggcacaatcacggctcactgcagcctcaacttcccaggctcccacctcagcctccctagtagctgagaccacaggtgtgcaccaccacacccagctaatttttgtattttttgtagagacagggtttcgtcatgtttcccaggctggtcttgaactcctggactgtaacagtccttgcgtcttggcctcccaaagtgctgggattataggcgtgagccactgcgcctggctcttcttcttcttttttttttttttttttttttttgagagggagtctcgccctgtcgtccaggctggagtgcaatggcgcgatcttggctcactgcaacctctgcctcctgggttcaagcaattctcctgcctcagcctcccaagtagctgggattacaggcgtgtgtcactgcacccggcactcttcttcttttttttaatggtaatattattgtacgttttttgttgttttacagtctagctggagtgcagtggcacaatcgtggctccttttagcctcgacctcctgagctcaagtaatcctcccacctcagccttccgagtaccacaggcgtgcaccaccacactctgctagtttttttatttttattagagacgaggtctcactatgttacccaggctggtctcaaacctttgagctcaagcgatcctcttgcctcagcctcccaaggtgctgggattataggcatgagccaccatgctcagcccaagttttatcttttaaattgcaatttttattaacacattgtagttgtacatatttgtggggtataatttgatgtctttatatatgttgtatagtcaaatcaggatatttagcatatctgtcatctcatgcgtttatcatttgtttatggtgagaacattcaaaagcctctcttctagctattttgtaaaatataatacccttctgttaactgtcgtcaccctgtgcaatggaacaccagaacttattcctcccaattataacttcgtacccattgaccagcatttttcaccaccaaaatatatagatctccagctataaataccacagaattacctttttttgaaaagagttggattttatggcagtttcctaaaaggtattatatttttcatataagtacccaattcttacctatgcattatcttttattttgagtaatttatgtttatatttgtctctacattctataaacattctataaatttgacctgagaagatctgtttttagcttcccaataatagtagtttgatgtcacttactcattcccttgaatagaaaatcatttgctttttcttcccatatctttaacagttattaaacagcaaaagagtactgtgcccaacactttaaatcttttactaaagaataccttttactttgtttttcaaacgtctgactagtttcttagccaagtgataacaaaaggtacccaggtaaaagtacatcttgaactttcatcatcctcattttcgagaggcttcagtgtaatataacaaacttttctgatagtggtgttaaaagccggggtggaccatcttaggagcttcttatctggaagaattcagtaagtggctagattaccacttaattggaaagtggagggggaggtgtatagagtgggggatggaggcagaaaatcaggtactctcgaggaaattcaagcaataataaatgtaaggctggattagatgatcttagaattatatttcatccctggaattctttatcatatgaaattagtttaaatgaaatatggaatatgcccctttaaaactttgacagttgccagtatcctcttaggtgttgaatttctcaatctaagatgatctattgggcctttgcattctttttgtctttattcatatgtaagaattaacacttggctttaaccataagaattcccaatatttccttagaaacgaatcttcccttactttccccacttcctctacataaacacatagatgcactcatgcattttaaatctttgggcagcagggtgcagtggctcatgcctgtaatcccagcactttgggaggccaaggtgggcggataacttgaggccaggagttcaagaccagaccagcctggccaacatggtgaaaccccgtctctactataaatacaaaaattagccaggcatggtggtgcacacctgtagtcccagctactcgggaggctgaggcaagagaatcgattgaacccaggaggcagaggttacagtgagccgagatcacgccactgcactccagcctgggcaacagagt[132 bp omitted]gaaaccccgtctctactaaaatacaaaaattagcaggacttggtggcgcacgcctataatcccagctactcacaaggctaaggtgggaggatcacttgagcctgggaggcagaggttgcagcgagccaaaatcgcgccactgcactccagcctgggcaacagagtgagacccagtctcaatcaatcagtcagtctttggaaggaaagctgtaacattgtaaccataacaaatagtaattaaggctaactgaagcacaggagtatagtagtcatgggccaggtccttccccctttgcccccccctatgaatagtcagtacatactgcatagtaatgcttaataaatgtgttaaatctatgactgaatggcagaatattataaacttaatttcagattgtctgtaaccatattgttcaatagaactttccacagtgggccaggcacagtggctcacacctgtaatcccagcactttggcatgctgaggcgggcggatcacctgaggccaagcattcgagaccaggctggccaacatagtgaaaccctgtctctaccaaaaatacaaaaaaattagccaggtgtggtggcaggcacgtgtagtcccagctacttgggaggctgaggcaggagaatcacttgaaccctggaggtggagg[138 bp omitted]aaaatgtggctactgtgactgagaaactaaattttttaattatacataattttaattaaatttaaggctaagcgcagtggctcacacctgtaatcccagcactttgggaggctaaggcagtcaaatcacttgaggtcaggagtttgagaccagcctgaccaacatagtgaaaccccatctctactaaaaatacaaaaattagccgggcatggtggcacatgcctgtaatcccagctactcgggaggctgaggcaggagaattgcttgaacctgggaggcagaggttgcagtgagccgagattgcaccactgcactccagcctgggtgacaaagtgagacaccgtctaaaaaaatttttttaaaaaatgaaatagccactcatggctacttggccaccaagttggacagctcagttctataacaacaatttcacggggcatggtggctcacacctgtaatcccaacgctttaggaggctgaggctggtggatcacttgagcccaggagttcaagaccagcctgagcaacatagattctctatttttaaatattttaaaaaattctttttgagataggttctcactctgttgcccaggctggagtacattggtgtgatctcggctcactgcagcttggacctcccgggttcaggcaattctcatgcctcagcctcccaagtagctgggactacagacatgcaccaccatgcccagaaagcttttgtatttttagtagagacagggtttcgccatgttgcccaagctggtctcgaactcctggcctcaagtgatccacctgccttggcctcccaaagtgctgggatcacaggcgtaagccactgtgctctggcctaaaatttttatgtttaaaaaaaaaattcaagaagttaggttacttagatattggaattcctatgacttttttagaaccagtggatgctctagcaataatactcactttgtgtgttttcttttgtttgtttagaaacattttctgagcaactgcttcttcaatagttaatgacgatgcaaaatgaaagacacagcttctgtttttaagatctatccctaaggacttgacaattgttataggtacagtgtgaaaagtaccattttaaaagcattcatagggtgatgtgggagacacagagaagagactacatgactgtttacaggagcccaggaaagcatctcagaaaacttgatgcttgaatgcttgagctgaaacctcaaaaggagtgtttgaattatttttggcctctgtgtttgctgttttctgtaagaacaggtttcttgggttacttgtaaagcatctgttatggtcagtttaggactaactttctcccggtctttcttttgcttcctacaagctatcaatttaggtccagaaacataggtctctcccttttcctccaactctgctaccttgacacctattttcttcctacagtgctctataaaaagctgcatcactgccttccacgtcacctgtgcctttgagcacggcctagagatgaagaccatcctagatgagggagacgaagtgaagttcaagtcatattgcctcaagcatagccaaaacaggcagaaacttggagaagctgagtacccccaccacagggctaaagagcagagccaggccaaaagtgagaaaaccagcctgcgggcacagaagcttcgggagctggaggaggagttctattccttggtacgagtggaagatgtggccgcagagctgggtatgcccacgctagctgtggactttatctataactactggaaactgaagcggaaaagtaacttcaataagccattatttcctccaaaggaggatgaagaaaatgggctggtgcagccaaaagaggaaagcattcacactcgaatgagaatgtttatgcatctacgccaggacctggagagggtaaggtgaccagctgtgactagtatataggcctcggtctgtgtagaaatggaggtcccacttctggtttaataatggtcagtcagctcataatagtgtgggcttctgtgtccttgcttatcttctgatctctttatggccccagacattgggctctgtgtaaattctgacaggcacatccaggggatttgggaggcctcgggtatatgctctatgaactttacatttgaaataaactctcatttggtttactttttattcactgttgagcctaaattggcccatccatattttactgacatatttatgagactttaggctgaagaaagagtgaattttgttcaggaaaacaccaaattagagtttcacaaacttggcactgttgacattttggactggatagttgtttgttgttagggggctgtcctttgttgtaggggcaatttaagatgtttaccagcatccctggcctctacccactagatgccagtagcacccgcacacacacccccagcgtgacaaccaaaaatgtctgcaaattaccaaatttgctctccagttgagagccactccacatgataattcaatataactcatggtatatttatcaggtatctactaaatgagatactgcagggcttcaaaggtaagttaagccctgtgtttatcctagagaattttctaattaaatgtaaatctataaatggcttgtgtttttttttctctgctaccagaatttgaaagagaactaatagatttggctcacttttaaaaatttaagacactcacatatagcacctactattactattattgccaacactgtcctaagcattttataaatattaattcatttaattctaacatgcccatgaaaaactattattatcatcatcactatttacagatgaacaaactggggcaaagaaagtttgtgtaacttgcctaggtagggagtatgagagagagagtatttcacctttgtggctgtggaaacttggttgagctgaaagtgtgagcaaaaaaaacacttctagtcttcccagtggaactgtatcctgctcgtccggcactgattagaaaattgtactggatacagccagcattgccatcattcgtactcagggatctaaagggaaggctgaattgttaaaccattattcagcttcccaacctggctgtgcaaataaatatcaagcccatgacactgcaaagagagtaggtttcagaaggcagatttggagcattttgcttttactattggttgatagatcccagaattgaccatgctgtgtgaattcctgtggagtgggtctcattctgcagctcttggattctgtcttctctcctcacccccacctgactttaggtctttattttagccaaacaatttcagttgtcaggtttgcttaacatgacaaacatctctatttgttggggattgggctttcaggtccgaaatctgtgctatatgataagcagacgagagaagctgaagctgtcacacaacaaaatacaggaacagatcttcggtttgcaagtccagcttcttaaccaagaaattgatgcaggtaacctgtatatttaaaatgtcctaacaaatatgtagactctggttatatcctatcttaacaatttaaatttcatgccagtcattccacttaaaaatcttttaaaattcttgtcagatatctcatttgcttcagtctaatcttaatataacctggcccatttcactgtcagttcataaggcaagaaatcccagggtggggtaggaggagttgcaggtctagggcaggtaatctaggtcccaaacagatattcgaggccattagtggaagccatgaaattattctgtaattatcaaattcatttagaaattgacgggataggatctaacacgtttccagaaaacacttaattctagggttactcatcttaacaatagtctattaaaacaaatccttagccagaagtaagtttggagatctgagttgttatcttttcatttattcactaatatttgttgagcacctacagtggactaagagctgagctacaagatacagtagaaagcaagacaaaatccctgcctgtagggtacactgcccacttggtgagcaagacaggtgagcataattatagtgccctaagcatagggagctgggctggaatgatgacagtcatattcagtgacacctgtaaactccctgtgcctcatttaacacagaggtcaatggcagagcctgggcaactaggggtcactggacagggtgtgcagaatcagctcctgccaagggagggtcagccatggagcatgagagagactcagaaatgaggtgacaggtgggtgtcagaggccttggggtatctgagtgtcatgggtctcaacagagtagtgtagcaggaggcagcaagactgctcagccacaaagggcaacatgacaagcaaaacaaggagaagcagaggacaacagggagagtccctgcatgccaaggaaattggctcctacccacatgccttctgatgtgtaggagtcaacctcattatgacttgcagcatcagcaggtgacagctcctgacagagatgggggttgtgggtgttcaaggtggacctttggggaacaaatgctgcccactgggatacctaagagctgtcctcttgatatctcatttttgtgagggtacagtaagatggtaatgggcaaaggtcaagtccatatacaaggaggaattgtttgatagtgctttttaaatttcaaagtacttgaaataatagaagaagacctgctctgactgtgattgtaggatgacttaactgagaaactgattgccgatactccccaaccaatcctatagcaggctggttggcaggaatgttatgattcttttctgctggccttaccactacaaaacctcccaccaccataatgttcatttgtagtcaggaaattattctaggttaaggatataaaatttatgggaaccacccaactatcacctctaatgccaagttcaaacacatacatactcttcacccaccaaaacccttgcaacgtttctgaaggtttgtgtttgccttgcttcaggaaggccagaagagattagaggatggggcctgaaatgtgtgtgtttaagacacatactaagtgctgtgccataccaacacatgcatgcacagacacacaaataggaagaccctattctaaaccattgctagagacattcttctcagaaatggaagggcagagatgggacgcaggaggcaacacactagtttgtgatcattttacagactgaaagagcagaggtgaagaggtgtggagccatatagcaaacagtggcattgctgagttcattcttggccccaacctctagttcagctcactccagctgctacaccatgatatacatacatagcagagccaggtgcttgttaaacatttggaagagtaggtatgtgaactcactctgccataagcacaaaagccattatttaaatcggttgttaaaacgaatctttcttttttatctcagggcttcctttgacaaatgcacttgaaaactcactgttttacccaccaccaagaattaccttgaagttaaaaatgcccaaatcaaccccagaagaccacagaaacagctccacagaaaccgatcagcagccccactctcctgacagcagctcatctgttcacagtataaggaacatgcaggtgcctcaggagtcactagaaatgagaacaaaatcgtatccgagatacccactagagagcaagaataaccgtttgctggccagtctcagccattctaggagtgaagcaaaggagtccagtcctgcttggagaaccccgtcctcggagtgctatcatgggcagtcactgggaaagcctctggtccttcaggctgccctccatggacagtcttccattgggaatgggaaaagtcagcctaactccaagtttgccaaatccaatggcctggagggcagctggtctgggaatgtcacccaaaaagacagctcgagtgagatgttctgtgaccaggagcctgtgttcagcccccacttggtcagtcagggcagctttagaaaatccactgtagaacactttagtaggtcctttaaagagaccaccaataggtgggtgaagaacacagaggacctccagtgctatgtgaagccaaccaagaatatgagccccaaggagcagttctggggtagacaggttctcaggcggtctgcagggagagctccatatcaggaaaatgatggctattgcccagatttggagctgagtgattcagaggcagaaagtgatgggaataaagaaaaagtcagggtaaggaaagatagctcagacagggaaaatcctccccatgactctagacgggattgccatggtaaaagcaagacacatcccctttcccacagttcaatgcaaaggtgattagaaacttccaaggatgacccaacctttgcctttgccccatatattggggaaaacccatacaccaaaaggattttagcatatgttaagaggaattgcagtgaaaaggataacatttttccatagtaaattgtcttgcagtttttgaaaatgtttcaagtctagtttttacaagcacattacagtaattgcaggttgtccagaggttggtttgtcagaggctattgggaacagctgggcccagggtatttgctcagtaaatattttggggcagctttccggttatataacacattgacaagtatatgtattaagagtccttgcattgttaactgatttgcaagagaccatgattatcagacactaaaactacttatcttttgaagctacagcatgtgactccccagagctcctgtctgtaggaagtttctaattccctggtatctataaacccttttcaggggagagaccggagaccccatcttagatactgtcaactcactactgtcttcctttgttctgcacaaggttgagtttctttcacagtatcttaacttactgagtcaatactcctcatgcttatcagtgtccagtgcctgttcctaaacttgcttgttggggacacactcataactatttcacctgactgacaagcataaaaggctaacttgtggatagtgtttacaaaagtacaaaagtactacttccaaggaaaatgctctgattctctgtttaggcatttgtgaaggattccagagcctttcccaaagtgagaccatttctggggtatttgtaccaggtcagggtttttgtgttgttttcaaataagtttgactaaaataagtttggctgacagtttttgtatacctgctttaatgtttataaaatttttattgaggtataattaaaatatagtaaaatgcacagaggttaagtattcttacctgctttaattttgaaacagatttttattgtcaaacagaatttgaaagcatgtgtttaacacatggatataatttagctttgtgtcacctttgaatctgaggcagtttcccaaacaaaaaggctggagccatttttcagaagttgcttataccctgttcccaaactatcagccttgattaatttctagtaggaagagaataattacatttgcgggggggggggtggataaaaaacatgtctgcttctcatttaaataagagagaaatgatgccgttttttaaatgtgaagcagactataattctcagctctcttttcttcttagccttaaattaatattctctttcttctagttttggaaagtgtagtgggaatattcagacaaaagaggccattttccatttttaaagcttcttactggtgaaacagcccagttgtagtaggtgccagtcagtcaaggcaggggccctctctccgtcaatatggaaaactcagcagttttcctctcccccagttgtgttcttgtaacgttgttaatgggttcctttgctttttgctttctccttttctgaaaatgtatgtgttttgcctctcttttggctacatcttcaaaatatttcttttgtgcctatgtacatgtgtaaacatgccatagcatgtgtggtaggtgtcctgtattttgtttgggaaaaaaactatcaaaatgaggaagagaatttcccctatttatgcactaggtttctgtgctttttctttgagttctctggagtagatattaatttgataccttcatggtaatgaaattatgatggagctgtgttataaattccttatgtcagaggccagtgcggtagcctttgtcccttcatgcctttcaattctgagtgggaggaaaagcaaacatcaaaacagtgcttcagccaaattccatatgtaatgccattgggagagtattgactaaaatatcattcgtcagggaaatatagttgtaatatttttacaggatattcctaggtaaatgaaggagccttcagttgtaaatttcaattaccccaaaatgtatttgctacattttgttgtttgaagtattacctcttaaccttctttgttaatttttttcattttgtcttatatagtccagttttccaagataagctcagtcctttttcaaatgtcccctttttaccaatactttttcattaaattatgaaaactgctacctactgtcagtgtgttttttattttggcatattggttacacatgttccttttatatttaaaaaattatattcactgaacaaaacagatagtgtggggagagggaggaggaagaggaggaattgaatgtttagaagcacacattcaacattcgagtcaataccggggacccaggagaactctggatacttgaactttacccagaaatcatgattttatcagactgttaagataaaggccttaggatcatcataaaacatcaccagagagatagatcctatctaaagtgacaagattgaaaaggcttcagtcaggcatctctatttggagtcttgtgagtatgttgatgtcatggggttatgtggtgtcaaggggggcttttaggcattataaacattttcatgattgaaaaatgtacttgccaaaggtcattgggtaaatcagtagtgaagataggtaaaaggtgaagttggttctctctctctctctctctctttctctctctctctgctagagaactgaaactacaggtataccctgttatagccaacaaaagctattgagtttatactaatgtgtacatttccaatgggagatgaatctttgtccttgtgttgaagcaactttaaattcagaggataagccaaagaatgcacaatcctgggttattttccttctaggactttaaaatcctcagtatgcttgctgacctttcagaattgaggaaaagtacatgatagaaatgaaaacttatttaccactgaatagctttcatgtgatattttccaaaaaatctaacttatttataaattttattagattttcacaaccttaattcagctattttcaagtttaatattaatagaaagcagcaattgtgtggggtttttttattcttttaactaacaaccatgcaagcttggatttttttaagtaatttttagttaataaagacccaccctgaggctatcacttctatgtgggagctttataacaatctagcactgtaaaagaagttcctttgaatacggttaattatactatacagattggaacaaattgcatgacctgaagatgtgaggatagttgttcttcaaataaatcaaggttaaggaggatcaagccccagactagtgtcccctactctatgtagtcactgatcatctttttttttcttgagttggggtctcgttctgtcacacaggctggagtgcagcagcatgatcagagctcactgtaacctccaactcgtggactcaaacaatcctcccgcctcaggtccagagtaactggggactacaggagcatgccaccatgcctggctacatttttctatttgtagagatggagtctcactatattgcccaggctggtctcaaactcctgggctcaagcaatcctcacgcctcggccttccaaagtgctggcattacaggcatatgagccatgatgcctgccactgatgatttttttttttttagggtcttagagcatccatcatttctcattttgttaagatggatttggatatgagcagtccagcctcaaggcttgaatgccccaagctttaaatttctttcccctcctctcactacttgcactcttcttctcaatttcatttattataactgaatatcaggttataaacaaggtggaaagatggaattggtctgttcaagctgtactgattacagcgagttatctgaattgggaggccatttgcggaaccactttttgctcaacattgctttctaaagtattgccataatgtaatgacactgctttcatacaccacacgtggaaatggatctcgttattttatagtcatttctcacatgagaaaacttcattcgaaaaattgctgaaattttgaaaattataatcacttcagcctcacaacagaaagacacttcgggttggaccagtaccattttagatctttcagctgctgcttagggaaaaaaacattaaatacgtattcctgcttcagataagcctggcataggtgccagtgttctggtaacagatttttcctctcttcaccttaacttttctactttacaaaactggatctctggttctttcccctccccctagctcttcaaacaaaggtggctctaggggttaagcaacaacagtgttcacaaagtggtggttagctgtgtgcagtactgtggccactcagtcttttcagtcatatttgccttcaaggacaacaatgaacaagatcagacagtgctgcctgcatctttggggcagaatttgtgcccgtgtcttgtcctccagtccttaaagatggactgagagctgcatgagcagtttcaagctaaaggtcagtttcaagacagctacttggggccgggcatggtggctcatgcctgtaatcccaccactttggcaggctgaggtggggaggatcgctggagcccaggagttcgagaccagcctgggcaacatgatgaaactccatcttattaaaaaaaaataaaaataaataaaaaaaaaccttggtcggacaagccaggaaacttgtttgggaccagtcaagccttcaaataataaaagttacaatattcatcaagcccttaacctatggcaggccttttgctaagccttttacatggggctaccttatatttagttctcacaacaaccatatgaagataatactatcagctgcatttgatacgtgaaaactgaggccaaatgtttaagacagttgttcaaagctagaacctgtgagcttgcctctacaactcatacttttagtcactttgcttgactcctgtgcccaaagccccctctctaaacactcttactcagtttcttcctgaggaaaccaacctgagttggggtttggttgtaaggattctgtaccactttatccgtgatgcctggacagagttgattggaccacaattagtcatctaacacaaagtcagtttagaggttcacatccaaaacacaagatacgtcacacaaatctgaacagtacagacctcacagatctaggacctggtggatttgccttctccgtagctaatctaacttgcaactgggcatagtaaagatagataatgcccccccaaagatgtccatgtcctaatccctggagcctgcgaatatgctaccttgcatggtaagaggggtttagcagatgtaattaaagttaagggctttcgaccccaaccattacacatgtagcacacaagcacatatacccccgactctaaaataaaaatttaagggccttaagatggggaagttatcctggattatctaggtgggcccaaccaatatagtcacaagggtgcttataagagggaggcaggagtatccaagtcagtaataagagatgtgacaatggaagcgggaggttggaatgatgcaaagaagagccatgagccaaggaatgcagacagtctctagaaatggaaaaagacaagaaacagaccccacctcagaaggttttcagaaacaactcagccctgcctatgctgtgattttagacgtttgacctcctgaactcttaagagaatatatttgtgttgttttaagccactaaatttgtggtaatttttacagcagaaatagaaaactaatacactaggcatactgcaagtgctccctacccttttgggggaatgttcctttcccagtatgtccatctctgctgtgatactctaggttggtcctgtactttcattagttgaaactctttccattaaatggaaaaccagtgtttttttttgatcaatagaatcctcccctagagaaattagttttctctttctcgtcccatccccccaacactttttccaaggtagcctttggtacttcttaggtagccttggataatcctccatgggcctgctggatccaccgtggctgaatctggcactgcctgaggagttgcccataggtttgtatggtcctgttgtctgaaaaactgtcctggggaagtagaaataattccttgagtgttactccacgggggaagttatagaaggcacatgtagctcattatgataaatgctttcgttatcagagcttcctaaaaggaagtgaatggcctgagagttgagttcttaaaacaccccagatacctgagccaagcttggaggttaaagaatgcaactctatgctgcctacaagaagcccactttaaatattggccgggcacagtggctcacgcctgtaatcccagcagtcggggaggccaaggcgggcagatcacctgaggttggcagttcgagaccagcctgtaatcccagctactctggagactgaggcaggagaatcgcttgaacccaggaggtggaggttgcagtgagccgagattgtgccattgtacttcagcctgggcaacaagagggaaactccgtctcaataaataaataaataaatacaaacaaacatacaggctgggcgcggtggctcatgcctgtaatcccagcactttgagaggccaatgtgggtggatcacctgaggtcagaagttcgagaccagcctggccaacatggtgaaaccccatctctactaaaagtacagattgctactaaaagtacgggcatggtggtgcgcacctgtagtccagctactcaggaggctgaggcacgagaatcacttgaacccaggaggcagaggttgcagtaagccgagattgtgccgctgcactccagcctgggtgacagagtgagactccatctcaaaaaaaaaaggagataacctgaatagctccttattattaaatgaattgaatttgcagtcaaactttcctttgaagaaactctgcccagatgacttcactggtaaattctaacaagctcttaagaaacagataatactaattatacataaactcttccaaaaaattggacaggagagaatacttctcaactcattccatgaagccagcattaccccgataccaaaaccagacaaatacataagaaaactagagaccaatatccttcataaaaattaatgcaaaaagtggctgggcgtggtggctcatgcttgtaatcacagcactttgggagggcaaggcaggaggatcacttgaggctgggagttcaagacccaacctcgccaagatggtgaagtccctgtctctactaaaaatacaaaaattagctgggcgtggtagtgggtgcctgtaaccccagctgcttgggagactgaggcaggagaatcacttgaacccaggaggcagaggttgcagtgagctgagatcatgccacagcactccagcctgggtgacagagtgagactccctctcaaaaataaaaataaaaacaatgcaaaagttcttaacaaaacgttagctaatttaatcgaagaatatatcaaaagtaagatttatcccagacatgcaggttgacttaacatttgaaaatcaatcagtgtaatttaccatatctcaatagatacataaaaagcatttgaggccaggtgctgtagctcacacctgttatcccagcactttttgggaggctgaggcgggtggatcgcttgaagccaggagtttgagaccagtctggccaacacggcaaaaccccgtctctactaaaaatacaaaaattagccgggcgtggtggcaggtgcctgtaatcccagctacttggtaggctgatgcatgagaatcgcttgaaccctgaaggcagaggttgcagtgagccaagattgtgccactgcactccagcctgggtgacagagcgagactctgtctcaaaaaaataaaataaataaataaaaacatttgacagtatctactgctgataatagtgttcagcaaactgtgaatagaagctgaataaaggatatctacccagaaccttat[131 bp omitted]tgagaccccatctgtacaaaaaaattaaaaattaaaaattagggtgtgggggcatacccattttttttatcagatcattagatttttttcctatagtatgaactccttatatattctggttattaatcccttgtcagatgggtagtttgtgaatattttctcctattctgtgggttgtctcttccctttgttgattgttccctttgctgtgcagaagctttttaacttgatgtgatcccatttgtccatttttctttggttgcctgtgcttgtgggttattactcaagaaatctttgcccagactaatgtcctggagattttccccaatgttttcttgtagtagtttcatagtttgaagtccattttgatttgatttttgtatatggtgagagataggttgtttttttttttaatagagacagagtctcatcatgttgcccaggctggttttgaactcctagactcaagcaatcctcccaccttggcctcccaaagtgctgggatcataggcgtgagccaccatgcccagccgaaaccactactttttgcaagatgctattaatagactgaaaagagaaatcacagactgggagagaagaatttcaaagtaattatgctcagccagacaaaacagaatacatactgtataaatataatcccaggtaccaaaaaaactacaaaataggagcaaatctggagtgacagagagcagactagtggttgcctgggggttaggagcagggaaaggtgggaggaagggataataaaagggcaggaggaaacttttgggggtgaccagaatgttcattatcttggtggtggagatagttctagacatgtatacatatgtcaaaactaatcaaattatactctggccaggcgtgggtgactcatccctgtgatctcagcacttcaggaggccgaggcaggaggatcgcttgagcccaggagttcaagaccagtctgggcaacatagcaagactctgtctctacaaaaattttaaaaattagctgggtgtggcagcatgcatccgtggtctcagctactagggaaactgagtcaggaggatcacctaagcccaggaggtcaaagctgcagtgagccatgatcacaccactgcactctagcctaggcaacagagtgaaacccagtctcaaagttaaaaacaaactaatcagcctggaatcaggaagttttacatggcctcttgacgggtaatgattggccttcagccaggttccatagacacaaagttgcccaagcgtcatcattacagcccatgaacattcacatggggtcttccaagtctaaaactgcaagtctttgatactaaatacctgcttccttcatgttttcctactataatattcaccatatggcaaaatttctctagggtcagtttgaaattactgcggccacattggggaacttttgagatgaacaagattgttcatttaagaggcatcttagaacaaagagtgaagaaaaccttattaggagattatttggttttgcctaaaagaaaaattattttggggggtaggtgaccccccctcctttgtttccacatttcaaggattaatgagtggtagctttaaaattctttacatggataaaactgtcaaaggcccaagttattgtctaaaccaataacttggtttagacaatactgtactctgtactctgtctccctccccaccccccagtgtgcttgtcaaaatggtctttctatgtttatatattcttccctgtccttcaagaaagaacaaaattaaccttttattatgttgatgcaaaagtaactgtagcttttgccattaaaagtaatggcagttccttttgcaccaacctaataaatgataatttcatatttgtctgaagctggctttttgttgttgttgttcctctccctctcttttactcccttgggaaactttaaagattaactgatcaaaaaaaaaaaaaaaattcagggccaggcacagtggctcacgcctgtaatcccagcattttgggaggcca[134 bp omitted]agaatcccttgaacccaggaggcggaggttgcagtgaaccaagatcacaccactgcactccatcttgggcaacagagcgagactttgtctcaaaaaaaaaaatttagttgttctgcgtacactctagaaatatctagtctggataaactgtcaaaagtgtctaaaggaaagaaaaagttattgaatgtgtttcttttcggggacactagaaagtatatttaacacaatagtctttgttattatacttatgaaaaaataagaaaagaatttaatttcaagataaagaagagctttcaattatgattgaagatctttaaaaatagtttaccattttaaagtaatgtcagaacaatatttttgcttgtacaaaaatcaggattaaattacttaagctttctaaatttcctacactgattttatgggttaagtaaattaccattgtttctataacttcatatatatatgaacgactgaaaggaataatactaacaggtgtctttttaaatagtttaattttatgaaaaaaaaaatttttttgagacagggtctcactctgtcacacaggctggagtgcagtggtgcaatcataactcactgcagcctcgacctcctgggctcaagcgatcctcccacctcagcctcctgagtagctgggactacaggcatgagccaccaggcctggctaattttttttctgttttattatattttgtcattctgcaccttcatgaaataatttttgttgttgtttttgtttttgtttgtagatacagtgtcttcctatgttgcccaggctggtctcaaactcctgggctcaagtgatcctcctgcctcagcctcccaaagtgctgggattacaggtgtgagccactgcacccagcctgaaaaattcttaaatttctacaaatcataaggatttaatgtattggctaaaattgaaatctctagatcccaactttaagacttaagacaaaagattaagttcattaataaataatctttggacacataagaaactgacagtttctgagtaaggaatagatagaaaacactagtcactgaaggtgattttttattctcatttcctaaagtggcacggtccttatcaactgtcaattcagaaaaattgcaaagaactggccaggcatggtggcttacgcctgtaatctcagcactttgagaagccaagacaggctgatcacctgaggtcaggagttcgagaccagcctggccaacatggtgaaactccgtctctactaaaaataaaaaaataaaaaaaaaaattgccgggcgtggtggtgcacgcctgtagtctcagctacttgggaggctgaggcaggagaattgcttgaacctgggaggtggaggttgcagtgagccgagattgcaccactgcactccagcctgggtgacagagcgagactctgtctcaaaaaacaaaacaaaacaaaacaaaaaaaaacagagaactcttggaattcgaaaaccacaataatcaaagctcttagaaaccccttgaacttccatagcctcaagtattgccattatttttcatggcaataagatctgcatccccccccaaaggattcacaagttatctgcttctgagataataacaggtttccctatgcatttggaaagtattcccaatgctagactccactctattacaggctgatatgactcattactgcaggggactcctacaatacctccagctttctcaccaacaggtataaactgcattttcttttttgtttgttttgagacggagtttggctctgtctattgcccaggctagagtgcagtggcccaatctccgctcactgcaacctatgcctcccaggttcaagtgattctcctgcctcagcttcctgagtagctgggattacaggcgtatgccaccacgcccgcctagtaaattgcgttttcaaaacccccacctcagcagcctctgcaggatctcaaacctgaaggtttggttttctgaaaagacatcagagaaaaactacttgagtctccgtggaaaagaccttatcagggactgttagcaacttgcacagcaataaaactccaacgggacacttaagttcccatttcccaacttaaaaagtcagtttatcctgactcctggatgtccattccatcgggacactttaaattaagacattcttagaagccctccagaaactgctgactgcagaagtggccagcttcaactcaaggttaattttctgattcttagcagcccttttctttcctttcactctcctgctcatcttgcctattgtgctttacactctctctatgatactaacagacgaaaaggcttctcagtgtgttctcccttaccctcatcctgtgacttctgaacccttacagtcccctctcacttaagaaaaaacacagcctgggcaacatggcaaaaccccctctctacaaaacaagtacaaaaatcagccagacttggtggagtgtgcctgtagtcccagctacttgggaggctgaggtgggaggatcacttgagcccaggaggttgaggctgcaatgagccgtgatcgtgccactgcactgcagcctgggtgacagggcaagaccccatctcagaaataaattaaaaaaagaaaaacaaagcatcctgatagatttttctcagagcatagctactgctctgaatttaactgtttgctgacaaaaaaaattaatcattcttccttaaacactacagaaggtacatttcctttagtaagccccttctggttcttaagtttcccttgcatcattaaccccaaactttggtcttataaaaactggccaggcacagtggcttgcgcctgtaatcccagcactttgggaggctgaggtgggaggattgcttgagcccaggagttcgagactagcgtggccaacatagtgtgacccccatctctacaaaaaataagaaaaaaaattagccaggggtggtgatgtgtgcctatagtcctagctaatcacaaggctgagatgggaagattgcttgagcccaggaggtcaaggctgcaataagccacagtcctgccactgcactccagcctaggtgacagagcaagacactgtctcaaaaaatttttttaaagggtggggagactaacccttgtcctactacagacaattttcttggagccacctgtagatcagcaaaatcctggtaaatggtgaagatcagaaaatcatcgattcacatcctatggcctttacttaatctgaccttggacaaaaggggaaattaaaaatgctcatcatcactggccatcagagaaatgcaaatcaaaaccacaatgagataccatctcacaccagttagaatggcaatcattaaaaagtcaggaaacaacaggtgctggagaggaggtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcttgctgctctaaagacacatgcacacgtatgtttattgcgtcattattcacaatagcaaagacttggaaacagcacaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactccggggactgttgtggggtggggggaggggggagggatagcattgggagatatacctaatgctagatgacgagttggtgggtgcagcgcaccagcatggcacatgtatacatctgtaactaacctgcacaatgtgcacatgtaccctaaaacttaaagtgtaaaaaaaaaaaaaaaaaaagatcaacagccaaaaaaaagaaagaaaagcagtctgtgacatccaaaatccgccatggcacccacagctaggccttggcattctcctgctgaacatgaacaatttcagaggtcaccaacatcagacaaggccattctgggactgcaatggatcaagacaaaaacaagattaatcatagactgaccaaatgacaaaaatggactggacctgatggctcatgcctgtaatcccagcatttcaggaggcagaggtggaagaatcacttgagcccaggagttcgagaccagcctggacaacacagggagacctcatctctacaaaaaattaaaaatctgggccaggtgtggtggctcacacctgtaatcccagcacttttggaaggctgagacaggaggattgcttaaggccaggagctcgagaccagcctgggcaaaacaaagtgagaccccgtctctactaaaaaaaaaaaaaaaaatcacaggccgggcacagtggctcacgcctgtaacccagcactttgggaggcc[134 bp omitted]gaggcaggagaattgcttgagcccaggaggtggaggttgcagtgagtggagatcacgccactgcattccagcctgggcaacagagcaagattccgtctcaaaaaaaggaaagaaagaaaaagaaagaaagaaagaaagaaagaaagaaagaaagaaagaaagaaagaaagaaagaaagaaagaaaggaaggaaggaaggaaggaaggaaggaaggaaggaaggaaggaaggaaggaaggaaggaaggaaggaaggaaagaatgaatcacaaaaatgactcaacatcgccccatcctggcttatctgagtgagggctgcttgttcttcagcccattctccttgtcttctagatgaaaattaaaatgcccaatcatggagtcacccctactccctgacagcattcaatccttggactcgccccaaaatcacatcacctaatacaaggccaaattctatagtagtttctttttaaaaaaaaaaaacaacttttttttttgagacagaatctcgctctgtcaccccagctggagtgcaatggcacgatctccgctcactcactgcaacctccacccaccagattcaagccccagccccccaagtagcttggattacaggcatgcaccgccacatgcactaatttttgtattttttgtaaagacagcgttccctatgttggtcaggctggtcttgaactccagacctcaagtgatccaccctcctctgcctcccaaagtgctggaattacaggcataaaccactgtgcctggcctatagtaggttctttctaacagcctgttactgagatgtcccagggtaccctgtggtgtgtgttctccctcctcactgtaaagagtcaatgaacccagatgtgtttgactgcaggtggtctgcgaataaagagcacttatattgtaataaaagatccctatgtatcctcagagagctcctgataaagcaggagagacacataaaccaatggatctcagtgtgatgagtaatgtaataaaacataaagaggcgctcctggaagagcaataggtcagagagcgaggagggtcagcgaagtcttcctgatggaggggacattcaactgactcttagttagaagttagtccagtgcagaaggaagcattggattagtggtcagagagaagtgttctaggcagagggaatagcaagttcaaagtcaagaagcagagaacatggctagaacatgagagaggtcaagaagggactccccacaaattcgaagagccttgtgtgctcggggtccattgcagggtgctatgactacacttttttttttattttatttattattattttttgagacagtgtctcactctcttgcccaggctggagtgcagtggcatgatcttggctcaccgcaacctccgcctcccgggttcaagcaattctcctgcctcagcctctcaaatagctgggattacaggcacacgccaccatgc[131 bp omitted]aaccacatattatgatcaaagttaacaaatcaacattcgtttgcctgcagatggtgaggatacagcatcacttttgtagcattgccaaaaaggcatagcctgaattgaccatgaggaaaaatcaaggaatcccaaattaagggacattctacattttgaattccaaaaatgtcaatgatgtcaggaaacaaaaataaaaggctgaggagctgttccaggtgaaaagcaactaaatgcagctaaatgcaatgcctcgccctggattgggtttgggcatgaaacatcttttttccttttattataaaggacattagttggacaattggtgagactccaatagataatcctgtatcaatgttaatttacctgattttgaccatcgtgctgtgtttatggaagagaatacccttgctttcaggaaacacacactgaactacagtatttaaaggtaaaggagcatcatgtctgcaacttgctcccaaactggtcagaaaaaaattatatatagatgtatatgtaaataagagagagaagggtaaagcaaatgtggtaaacttaacatttggggaatctgggtgaagggtaatcatgaattttttctattattcttgcagcttttctgtaaaactgaaatttttttctaaataaaggtacccctctcagcaaaaaaaaagaaaaagaaaaaaaagcatatagtttttgttgttgttgttttgtttttagagacaggatcccacatcccactctgtcacccaggctgaagtgcagtgtcgctatcacggctcactgcaagcttgatctcccaggctcaagcgatgttcccacctcagcctcctcagtaactgggatcacagccaccacgcctggctattttttttttaatagagatgagatctttctgtgttgcccaggctggtgtcaaactcctggcctcaagtggtcctcctgcctcagccccccaaagtgctgggattacaggggtgagccacggtgcccagcctgaaaagcatatagttgaacaacctctatgtgtcagcactgtggcaggacccagggaggtgagggtgaataagatacatcccctcccctgcaagactcacggtctagcaggtcattttggcagcagatccacagggatgagatgaggcctccgggaagattaaaacaatctaggcaagaaatggggaaagcctgaatgaattaaggcagtgccaacatagaaggacattaaagggacaattctatgacctggtgactaactggacttgagttagggaccaagaggaggctcgcgaggtgtcagggcttcttgcacagccagttggctgcaccacagcccatttcccaggacagagtgctcaggaggttggtgggaaatgatgtgattggtttgggtcagctcagttaagctgctggcctgtatcctgggggcgacatctgggctgagataaggttagggagacatcagcactgaggaagtagaggaagagagttatttttgtttgtttgtttttgagacagtctcactctgtcacccaggctggagtgcagtggcataaactcagctcactgtagcttcaacctcctggactcaagtgatcctcttgcctcagcctcctgagtagccggaactataggcatgcaccaccacacccagaaatacatatatatgtttgagaagtagtttcactcttgttgcccaggctggagtgcaatggcacaatttcagctcactgcaacctccgcctcccggattcaagcaattctcctgtctc[133 bp omitted]cagcctcccaaaatgctgggattacaggcatgagccaccacacttggccagttttgttttgttttgttttgttttgttgttttttgggtttttttaaatttttagtagagacgaagtctcactttgttgccaggttcatctcaaactcctgggctcaagcgatccaccctcctcggcctcccaaagcactgagattataggcctgagccactgtgccggccctggccatttttttttttaatatgggttatttggagaaagcccagactgtcagatggcaggaccaggaatacatttaggctgagaatggggttgtggagctgtgttgttgaggaatgtgttttccatatgatttgaaaatgaaatcgagcctttcctcttcccccaccaaaaacgtttttgcaagagttggccttcagccaccagggtcttctccactaggatggagaggagctttgttctttcctttttaacctgtttgggtttaaccgtcccagtctctctctgttcggcatttaacaacttttcttggttgaagtaagaggtaaactagctattcgtccaaactccaaagctcaggttcactgggccgtaagcctgtacccaccatccccgggcctgccaggggcggctttgcaggattcttccagccgcgggggacggggacggggacggggcggggtcccaggcccatgccatccacctgccaagccgccgggtcccgggaggcgtttcccctcccctcggcccgctgcctgaccttcgagccgcctgagaaatctccatcctggcgagtgcccgagccaggccggcctccccgccccctccctggaaaggaaaggccccggcgacaacagagccagacccgctcatcccgatctcccagaaggcgactgacagctgactgccagaaggagatcgcgccaggagactgactgctctgtgcccacccggggacccgggcccgttcagccgggctggctggtgcgccctctgcaaagcctgcgccagggaggaggcaggctcaaccttcagattcccagggcctctctgtcgctgtcgccgtcgccgtcgcccgaggtcccagcggctctaccagattgttgtggaggcctctcacccgcacaggtaccccgggtgcagcgcgggcacctgaagccccgtccccgctccctgctgcccagccacccctttgtggtcacgggccgggcctaaatggaacatttggcacccccgtcccctccccaccggcttctactagggagcatggggttaaaagtcgctattgcaaaagtcgtgccactgctcttgagccttatctaagactgataggatgaaggcctttgtagtctgaacactgccccccacccccgcttttttttttttttttttttccgagacaaggtctcagtctgtcgcccaggctggagcgccatggcccaatctcagctcactgcaacctcctcctcccaggttcaagcgattctccggcctcagccttcctagtagctaggaccacaggctcgaaccactaagcccggctaattttttgtattttttgtagagacgggctttcaccatgttgcccaggctggtctcaaactcctgacctcaatgttcctcccacctcagcctcccaaagtgctggaattacaggcacgagccaccagcaccggcctgagcccatttttaatagccaaaaaacatttcaaatgctgctgcagatgcaggcagtttgtatttgggaccagtttgggctgaggtttttttgtttgtttttttttttgttttgttttggtttggtttggtttggtttctgtttttgttttgttttgttttgtttttttgtttttttggttttttttttgagacggagtcttactctgtcgctcaggctagaatgcagtggcgcaatctcggctcactgcaacctctgcctcccgggttcaaacgattctcctgcttcagcctcatgagtcgctgggattacaggcacccgccactgtgcccagccaatttttttgtatttttagtagagatggggtttcaccatgttggtcaggctggtcttgaactcctgacctcatgatccacccagctcggcctcccaaagtgctgagattacaggcatgagccaccatgcccggcctgtgtttcttttttaaaatgtagtttattgaaggaaatattagatcaaacattatttttcttttttccctctctattcatttgcccatcatgtgtaggaccacttacttcaaagcagatagctaccctgggagaaggatgaagatgcaggccatttttatttatttatttagagacaggttctcgctctgttgcccaggctggagtgcagtggcatgatcacggctcattgcagcctccacctcctgaactcaaatgatcctcccacctcaggctcccgagtagctaggaccacaggcatgtgccactacacccgctaattttttgttgttttgtagagtcagggtctcactatgttgcccacaccagtcccagactcctgggcccaagcaatcttcctgcctcagcctcctaaagagctgggattacaggcctgagcccctgtgcctgacaaatgcaggcagtgtggatcattcctggaaaccgcctactcagggcagaggtacagaaagaaaagattgctcttgaaagttgcctgtctttcctctcccacatgggattcttatctgattttttctccttttcagataatttttctctgtcttctcccagttcgctggtcatggtctctggcctaaagtcccagcatagactgttcctctcctgtggagtctaacactctttgccaaactggcacggtgtcttcctgggaagcaagaaatcactgagggcctgtcagttcctgccagggtggttcgatgctgtccttttctccactccttccatggtctgcgttggaaaatgtgtgttagttcgaattcagcgagttctcattggggtgaacatagtcctaaaaatgcagttcataaaaatcaaccacacagagaagaaaaataaataaatcagtaaagcagctcagaaaaatgcaggtgtggcgggccctggcctctgcaccctcatagaggggctcaacagcatcaacagaaggtgggggagcagaaggtgccctgcagacacccagaggggccaccaatgagcaaactgccagctccctgacccgccctggggcccagggtattgacataaaggacggccttgcactatttcaacagccagttctctgagggtcacaaacaccaaggagtggaggtcagagtgtcacttttttgttttctttttgaaagatcattcgagaaacacgtcactggtaagttggttgaagatgtttcatggtccctgttatcagctcttttcttttgcctatgtgtctctccctgtcacattgcatatcctgctctgatctgggggaagtgtatccagccttgccagttcttagccaggtgttttactgtatttgttctgtgcgatgacctttcactcacctctgttaccttcaatagatctcccctgcgaccatgtcttccattaagattgagtgtgttttgccagagaactgccggtgtggtgagtctccagtatgggaggaagtgtccaactctctgctctttgtagacattcctgcaaaaaaggtttgccggtgggattcattcaccaagcaagtacagcgagtgaccatgggtaaggatgaaggctggactcagatcagccagctaccttttcccaggggaggggcggtcaccacggcacccttcttgttaaagcacactgactacacttgtcacgctgtctgtccccactccatatcctcccactttgacccagggtttaattatggatggtcaatactttcctcttcctctttgaatgaggggcaacattcctagtttttttttgggggggggggtgtttttgtttattttttgttttgtttttgttgagacagggtctcaccgtgttgccctggctggagtgccatggtgtgatcacggctcactgcagccttgatctcctggggctcaagggatcctcctgcctcagcctccctagtagctgtgactacaggtgcgtgccactatgtccagctagtttgtattttttgtagagatggtgtttcaccatgttgcccaggctagtctcaaactcctgggctcaagagatccacccacttcgacctcccaaagtgttgggattacaagcgtgagctaccacgcccagcccattcccagttttgtttggatgctggggcactctagttcctgtctttccttaataccttcagataaccatggaaagttaaagacccagttatctgccttgggtcaggccaagaccttaattttcaaacaaaacaaaacaaaacaaaaacaggtgcctctcttccttgaaagtgaaaactagcttttggatgtataaagcatcaaccaggaccgtctttgtttactgcacaaaatagaattcatgatggaatttcatgtgcatttgagtgtgatgcgtttatggccctgcgaattctaaagaagggatttatcactttctatggcccaagggaataggcttaatgtaattactgatagagaaagaagtttcttgttttcactgagcccatgggaaaaaatatcaggaa[131 bp omitted]actacagcctcaatctcccaggctcaagcgatcctcccaccttagcttcctgagtagctggaaccacaggcatgtgccaccacacctagctaatttttatttattttttgtagagacagggtctccctatattgcccaggctggtcttgaactcttgggctcaagcaatcctcctgccttggcctcccaaagtgctgagattacaggtgtgggccaccacgcccagccttaaacttctttatttttaaatgaaagggaacaaatttttaattcacccagaagtatgactgtggtaaagtgactgtgacctctgagggtagaatggggatggggtccccttgccttttctagtctcttttgcagcagacacacatgccaacctgtgatctgaaaagcccgcccccaccaccacccgcccccaacccatggaaaaagctgtggtgtcagcagtagcttagagagctaccaagagaagtctcaggctgcaggttgggatccccaatgagagtgtgtcctacacattccttgggacccttgatggctccaatcaaagtgtgagcagggctttgagctaagggtggctcctgaagctcccattatcttacactgaaggggtgcttaggaaatgctttcaaaatctattctgataaatttatttcctgtgaccattcaccacagcaatcaatctctccacttaaaaaaataaaataaatttaaaaaaaaagctttcttggccgggtgcagtagctcatgcctgtaatctcaacacttttgggaggctgaggtgggtggatcacttgaggccaggagttcaagaccagcctgaccatcatggtgaaaccgtgtctctactaaaaatacaaaaattagccaggcatggtagcacagcctgtagtcccagctactagggaggctgaggcaggagaatcctttgaacctgggaggcggaggttgcagtgagtcaagatcacgacactgcactccagcctgggcaacagagcaagactccatctcaaaaaaaaaaaaagttttcttatacatggaaaaatattaaatgaagaaaacctaaaatttaaaaacataaaatgtagtaatataatgaagagatgtgattgtactatctctgcatctacattcctatctgtttattattttttaccatgcttacttccaaaaaaggatctgagaaacaatttgcaattaaatacatataaaatagggccccttagaaaagacgaatcctgggcctggcgtggtggctcacgcctaatatcccaacactttgtgaggccaaggcgggtggatcacctgaggtcaggagttcgaaatcagcctggccaacatggtgaaaccccatctctactaaaaatacaaataaaaattagctaggcgtggtgcatgcctgtaatcccagctactcaggaggctgaggcaggagaattgcttgaacccaggaggcagaggttgcagtgagttgagattgcaccattgcactccagcctgggaaacaagagcaaaactctgtctcaaacaaaacaaacaaaaaaaaaaatgcaaatcctggattggagagggagagagatgtcacaaaacctagttgctgtaaataaactcggtttgtgtctctgaattttctggagcattttctggcaaaatggggcatcactcgctctgtgatgactgtcctggtgcccctagattagaaactcctcctctgaactggatgtggcacctgccccatatcatggccactgggctttcacttctctgcttttcccacaagactgggagcttccagaggagttgggtttttttcacatttctatctattgctgcccagatcagcacacaaaattcatactcaacaaatgtactaggttacatagccttccctactcaacagaaggaagagagcgctcccattgtcacgagagctgggctcccgctctaagagatgccaggtagcacagtgatctcagtggcctcagccactaaactggtactgttttttaactgttgctttacctctacagatgccccagtcagctccgtggctcttcgccagtcgggaggctatgttgccaccattggaacaaagttctgtgctttgaactggaaagaacaatcagcagttgtcttggccacggtggataacgacaagaaaaacaatcgcttcaatgatgggaaggtggatcccgccgggaggtactttgctggtaagatttctcttaacacctacttattactgagccttggaggaaatactttgacatacaaagttctcactactgaccagggtggtggctcccgcctgtaatccagcactttgggagccaaggcgagtaggtcgcatgagcccaggagttcgataactgcctgggcaacatagtgaaaccctgtctctaccaaaaatacaaaaaattagctgggcctggtggcatgcatctgtgttcccagctactcaggaggctgagttggaaggatcatctgagcccaggagtttgaggctgcagtgagccaagatcgtgccactgcactctaacctgggtgacagagtgagacccggtctcgaaaaaagaaagaaagaaagtaagtaagttagttagttctcactacctcaaaagtgttatttataatgaatcttgggttcttcttttattattgcctgagtaagttgtaggacaaaaaaaaaattctatgataaaatcttcatttgcatttccatctctagcagagactaaaatctgtatggtattttggtggtttaaatgagttttaaatacaggggttttgttgttgatgtttaaatcag[224 bp omitted]gcaggagaatggcatgcacctgggaggtggagcttgcagtaagctgtggtcgcaccactgcactccagcctgggcaatagagcgagactccatctcaaaaaaaaaaagaatagtacaaacaacacttgtataccttttacccgggttcacctattgctaacattttgttccatttgctttatcatttgctgtctgtatatatctaaacatctttatctccagagtcctttatttaaaaaaaaaatagagatgagatctcactatgttgcccaggctggtctcaaactcctgagctcaagtgatcctcacacctcttcctcccaagtgctgggattacaggtgtgagccactgcacctggcctatctccagaatcatgtgagagtaggttgcatgtatatcctatgtgcctttacccctaaaatgctgcagtgtgaatttcccaagaaagacgacatattcttacatgaccacagttacagtgatcaacttagagaagtttagcattgacacagtcattttatctgatatactatctaaatcccagttttgtcaattgtacaaaaagtgttctttctcacatttttccctccagcacaggatgcagtctaggctcatggattgcatttccttttcatatctctttgatcttttttaaaactggaacattttcatagctttttttgtttgttttttataacattgccatttttgaagaatacagccaggcctacccaactcccccttttttaatagggcattccttatttagtatttgtctagtgtttgtttgtgattaagttgatgttatacattcctgactggaataccgcatagataatgttctgttctcagggtaacccatctggaggtacacgatgtccgtgtgtcccctcgttagtgattttgatcaccaggttaaggccctgtcagatttctctactgaataactatttttaatgcaatttataagcaatttgtgggggttgttagttatctattgctggataacaaattaccctgaaacttagaggcttaaaataagaaatatttattatctcagatggtttctgaaggtcaagaatctgggtgcagcttagctggatggatccagttcaggctatctcataagactgtagtcaagctttccacaggggctgcagcctcggaaaaggctggattctctgcagaggtctgaaagatccacttccaagctcattcacataggggttggcaggaggcttcagttccttagctggtgggtctctccacagggctgctcaggacatggctgcccctagaaccagtgataacaggagagagagagagagagagagagagagagagagagagagagagagagagaaagagagagagaacgcatgcacccaagatccaagatgcaagctacagtctttaaccaatcggaagtgacataccatcacttatgccatatgctattggtcacacagacaatgacagagggaactatccaagggtgagaatgctgaaaggtgggaatcattaggggctatcttggaggctggctacaacatggggagatactctaagtccacacaaatatcctggtcctcatcaaaatttcttccttaagttttacattcattgatgattctttcttgaaccaaagtttactatgatggttgcagaatgacttacatgcaggtttaaaagaattttatctacagttttaaattagatactgcacttcacatatatttctcatcataataaccttctgagttagccgaagttgattctccatctctactattcccaccttcccacactgccgcctcacattgttggccctgctgtcctggccctgtgcaacttcaatatggaaggcaggagaggtcagagcagctgactgtagactgcttcccatcttcctggactttatacaaccacagatatggtccgggacaggttgaaagattaaagatgagaatctgttggaagcccttctgcagtaatttctgcaagataaagatatgtgattggatatttcacctcctggtgaaattgattttctctccttcttttaagtagaagttgacagttctgtgctcgcttcagcagcacatctactaaagttggaacgatagagagaagattagcatggcctctgcacaaggatgacatgcaaatgcatgaagagctccatatttttcttacaaagtttacagttctgaggcactctgtgagacaaaaataaagatggcctccaaggcctccattctaagcatggagtctctgggccatcaggagacctcttaaaattgcaggtgtcattgtaggtgtaactattaggtattactatagtattctatagtactaataccaatactataatattatacttataataatatatagttttactttatgtattatcatatataattttaaattatatattataatatagtattataattatataagcatatataatataatcatattatatataaatataattatatattatataatatataatacaactatatatattatattaatatataatattatattatatataattataatataatactgtagtattctggcagatgcataacactagtacactagtatatacctgttaggtatatactagtgctatgcatctgccagaagcacctgagactctttctcaagagaggtcatagctcttggcaggtgctcggaggtgccccaggcccagaaaaaggtggggttatcttatagtctagatggattctcaaggtgatcgcaccctgaatatatcaccacacccaagatctgacctgtctatgcttgttactagataatgaagccagggctctagattattctatccaccaaggaagaggctttccaagcagcaggagattcacatgcatgttccaggcctctttttctgtgaggcagataatgtgcagggagagtcatgaaataaacccaactgccctagagcaggaaactgccgagggaacatccttctccccagggagggaggatcgaccctgtcttgcttgctattcaggcttcccatctacattgtctctggcatctgtgccatctcattttcggcatctgttgattctcttctcctatgtgagttgagatttccatgtttctttgtgttgccaagtaatctggggttgtgttctagacattttgaatattatgaggccctgagtcttgttgaaatcctttggccgggcgcggtggctcaagcctataatcccagcactttgggaggccgaggcaagtagatcacttgagctcgggagtctgagaccagcctgggcaacacagtgaaaccccgtctctacaaaaaaaataaaacaaatgagccaggcatggtggcttactcccatagtcccagctgctcagaggcggaggtgggaggaatgcttcagtccgggaggttgaggctgcaatgagctgtgatcacgccactgcactccagcctgggcaacagagcaacactctgccaaaaaaaaaaaaaaaagaagaagaagaagaagaagatagaagaagaaggagacggagaaggagaaggaggaggcttggcatggcagctcatgcctgtgaccccagcactttggaggccaaggcaggtggattgcttgagctgcttgagctactcgggaggctgaggtaggagaatcacctgagcctgggggaggtggaggctgcatgagccgagactgcattactgcactccagcctgggcaaccaggcttttcagagttccaagatggctgtgccatgtattttatccaggttttatagctgtgctcagtgggagaaaatgaggttcgtgcatgtttactccttcttatcttgaaccagaacttctaggcacagttttaatttgcattatatgcaagataattgtcattttatatatatataagtatatataatataaaattatattatataattataatataatataatatataatcatataatataatttatataatattatattatataaatataatataaaattatatatacatatattatatatacttatatatacatattatatatacttatatatacatattatatatactcatatatatacatattatatacacttatatatacatattatatatactttatatatatatatatatatacacacacacacacacacacacacacacacacacatatatatatatggcccagattggaattgtatagtgatttcctttgatttaatcactggaaaggatccctggtgagaaaggatggtgtcgtgcatggggtaagatgctatggggcagagctcagtgctctttggtttttgtaggcaccatggctgaggaaacagctccagcagttcttgagcggcaccagggggccctgtactccctctttcctgatcaccacgtgaaaaagtactttgaccaggtggacatttccaatggtttggattggtcgctagaccacaaaatcttctattacattgacagcctgtcctactccgtggatgcctttgactatgacctgcagacaggacagatctgtatgtatttttcattatttgtctcagtgctgccactattgttttcatatgtttgtgactagtaaggcgcctctccctcgcctcatgtgaagaagtcttcacttaaatggagagctttctgatgctactattctaatatagtaacgacagcacagacttgactgtgctgccaatcaaatcatggtcctcaacatatttaaatatggcaagagtttggcataatatggatagatctggggaagctaataaaaaataattaatacaaatatgggtagattctcaatccttttccttgccatcatcaccagaaagaggttcactgcaaaagagatcctattctaccaggaggtgcctaaaggcagataatacttaatggagtattggcgcaaaagagcagaaaacttgaggtttttgattgctatttcttgtttgtactttagttaaccataggcaagtactcagaagctaattaccaacctttcaaaatggaaaagcaaaaaaaaaaagtaattgcacgttgtccaactccatcaatacgcttgaaaggagccatagttggaaactgggagggaaggaattatttagaatctagaagggagtccttgaaactgtttcatgaaaggtgccaaaccttttatgaaacaaaagagcaacattaataataaaaatgacttggaaaaaatatccccagaactctgcatgcagatttaatcagaggcaaactattctggtgcagatgttttgctttgaaatatgtagtgctcgggaggctgaagcaggagaatcgcttgaacccgggaggcaggggttgcagtgagccgagatcgcgccactgtactcctgcctgacgacagagcgagacactgtcaaaaaaaaaagaaagaaagaaagaaaagaagaagaaagaaagaaagaaagaagaaggaaagaaagaaagaaagaaagaaagaaagaaagaaagaaagaaagaaagaaagaaagaaagaaagaaagatgtagtgctcttttttatgacagtttttacccattgtcattgtatgtggttttaacatttttccattatacctcaatctaatgactgtagtgacctggactttgtagtataaagttttggattttgatatttgttttttgtataccacggttacccccctttaagggcacctagtttgtttctgagtgcccctcctgcaagaaacaggctcttctaatatttagtcttgaatttggagcactcagtcaggcagaaaaagaattcatgtatcttgctagtttttgtgcatgaactgttcacgtggtaccattaagttgccttgcggatctcaagagttttgtaactgaaacagcaaaggtctaaccacaagctgacatgtacttgacatagacatgcagggccccagttcaggtcagcttcaaaaagaagtattattggtattttagtaagaattctgctttcttttttctctctccatctgaatgcttaaacagatatgcctgtacccaaacaaaagacaatgaatccatcccaatcatgtggtaaaaatcctttgttcacatgccagacactggataagctgaagtgatctgtatttataaccagcttgagagctctcggtttgattctcagtatttagtggcctgttgttttgttgtggttctgtttttgtttttgccttttaaccatagccaaccgcagaagtgtttacaagctagaaaaggaagaacaaatcccagatggaatgtgtattgatgctgaggggaagctctgggtggcctgttacaatggaggaagagtgattcgtttagatcctgtgacaggtaggcctgcagcaaaatgaaaaatccttgtcatggctaggcagagatatagcccgaaagttacagtcagaatttcttttcctgtagaggtgcgactttttgctcaaaataaattgtcagggaaagtagattaaatattaaatgcacagatgaatcctgacctccacagtcttcttagatcttccctagaaacaatacacaggttggaaattgctacaactaaacttaaaataaaatatttggtggtctagggaaaagacttcaaactgtgaagttgcctgttgataaaacaacttcatgctgctttggagggaagaattactctgaaatgtatgtgacctgcgcccgggatgggatggaccccgagggtcttttgaggcaacctgaagctggtggaattttcaaggtgatatggctatttcttttattttgggggtgggggatcccaaatacttacaggggtaagtaactgagtgattggtacttttgcatacttccaaagcataatcctatttagcatgttaagctcatcatactagactgaaaaacattttatttcaattttctagagagtaagttatctgaagtccaagatgatctgtttagcctactttgtacattaatttttttacttcctgtttattgaaattcttcagatcagtagaatgaacttggaaagccagtatttacaacatgcctagaagatcagttgattgttttgatgtcttaaggatttttcagattttaaacatcttttggcagcagaataaacactgataaaaatcgtagagcttttgagctgaaaagaaatacataatgtagaaacccctttcttagcaggcggcagatgataggagtaatccagttttaaatctaagttagtcgtaaatgattgctagttgaattattaactatatgaataattgggttggaccataaatatccagtcaggtaattcctttttatgataggagataaaacaaagataataggtggctaagtatattactacaaatcataaaaatgcttttgaagaatacttgtgaattacctttcacctgagattccctcttttctttttcaacagataactggtctgggggtcaaaggaattgctccctactcctatgcgggatgaggacaggtcttctttcctgccagagggagctctgaagacaactagagaattctgggcctgaaatttcaatctagttagaaagaaaaatgaggcaatgattttattaacagcgttaagttttaatttacaacttttaaaaggcagagcatttttaacaaggggtgacaggtggttttgataacacacttataaggctttctgtaaaaggtactatagaagggcgaagaatcgttcaactgtcaatcagcctcttgattctttgtaaattgccagggtgggtgggtacatatctcttcttgattctgcatttcatacttaactatattaaagcttcaaggaacaataaatagtaacctggtaatgacctattatgttcctttttattttcatcacaatcttataaaatataccacaatgctaactaacctacatagatatttcatctcctatatgttattttacaaactaaaatacggctggagggttagactcaaacatgctgtcaaaatccatggttccagctgccacctactggatgtaaaagtaatatgtctctttggaaagaatacttattttaaaaatagctttattgagttataattggcctgtacatatttaaagtgtataatttgacaaatttgtcacatatatacattcatgaaaccaacaccacaaacaagataatgaatctatccactaccccaaaacttttcttgtcctgtcataatccttttcttcagcccctctgcctgcctgtcccctgctcccaggaaaccactgatctgctttctgtcactataaattagtcttaaaattaggtagtgtgatttctgtaactttgctctttttcaaaattgttttggctattttaattcctttgaccttccatataaattttcaaatcagcttgacgatatctacaaaagaaatcaagctacaattttttaattggaattgcttttttttttttagacaggatctactctgtcacccaggtcggagtgcaggggcacgatcatggttcattgctgcctctacctcccaggctgaagcaaccctcccacgtcagtctcccgagtagctgggctgagactgcaggtgcgtgccactatggtcattttttcgtttgtttggttggttggttttttggattttttgcttttcagagacgaagtcttgttatgctgcccaggctggcctcaaactcctggtgatcctcccgccttgacttcccaaagctctgggattacaggaatgagccaccgcgccaggcctgaaattgctttaaatctgtaaaacgatttggagataattgacttctttactattctgagtcttatccatgaacagggcatgtctctcccgttatttaggccttcttcaatttttgtcatcagtgttttgtaggtttcagcatacagatcttgtacatgttttgttagatttatatccaagtatttcacttttgggagctattgtaaatgttattattattattatttgagacagggtcttgctctatgggccaggctagagtgaagtggcacgatca[137 bp omitted]ttgtttatagaagtgtgattggcgtttataggttgactttgtatctgatgagtttgctaacctcactaattggttctaagagtatttctgtagcttctctgagattctttgggtgtataatcatgtcttctgtgaatagagacaattttctttctttctttccagtttgtatgtttttatttttcttgcattattacactggctaaaattgccactattatgttgaatggaaatagtaagagtagacagccttgtcttgttcccaatctcaagagaaaagcatgcagtcttttattattaaatatgatattagttatatgtatttttgtggatggcctttctcaaattgaggaagttcccttctcatttacttttctgcatgtattaatgtgattatgtggttttccttctttagactgttaatatgatcaattcttgcattcctgagataaacctcccttggtcatgacatattactacttttatgtgttgctgaattccattttctaatattttgttgaggatttttgcagctactatcttttgtctgtggttgacatcagggtaattctggccttataaaatgaattggaaagtattccttcttctactatctggaaaagaaaatgtataattattattcttctttaaatatttggcaaaattcatcagcgaaaacatttggacccggagatttctttttcagaagctttttaacattccttaataatgacaaggccacttggttgccttacttaattttggtgaggtctgttagtttgcggcttccaaggaattgatccttttcatctaagttgtcaaatttatgtatgtagagttattaatagtatttccttattatccttttaataatgcctgagaggtttgtagtgatatccccttttttacctgctattggttatttgtgtcttttttctttgtcagtcttgctagaggtttatcagttgcattgatctttcaaagacctagcttttgatttcattttttggttgtcaatttcattgatttatccttttatctttgttattccttccttctgctttattctgatttattttgctctttttctagtttcttaaattggaatctcagattatggatttgagacatttcttctgttctaaaataacatttaatgctatacattttcctctcagtactgctctttctgcagcccacaaagtctgatatattgtattttcatttttgttaaattaaaaatattttctaatttccttggagacattttctttgacccatggattatttagaagtgtgtttaatttctaaatgattggagattttattattatctttttgggtattgatttcagatttaattctattatggtcagagagcatattttttatttcagttctttgaaattcaagttggatttgttttttgtttttgttttgagatggagtctctcactctgttgcccaggctggagtgcagtggtgtgatctcagctcacttcaacctccacctcccgggttcaagtgattctcccacctcagcctcctgagtagctgggattacaggtgcccaccaccaagcccagctaatttttgtatttttagtagagatggggtttcgccatgttgactaggctggtctcgaactcctgaccttggcctcccaaagtgttgggattacaggcatgaccctttctccttcatgttacaagtgtattatatattctgtatacattgaaaactcatcagtgttaaaaacttttgctttgaactgtcaaacatgttttaaagaactcaaaaggagaatagtccattatatttaccaagatgtttaccattcctgttcttcttccttcattcctgatgttccaagtttccttcttgtatcctttttatagtttacagaacttcctggctgggaacggtggctcttgcctgtaatcccagcagtttgggagcccgaggcaggtggatcacctgaggtcaggagttgaagaccagcctggccaacatggtgaaaccctgtctctactaaaaatacaaaaattagccgggcatcatggcgggagcctgtaatcccagctactcaggaggctgaggcaggagaatggcctgaacccgggaagtggagggaagtggaggtcgcagtgagctgagatcgcaccactgcattccagcctggaaaattcgatttaaaaaaaaaaaaaggaacttcctttagcaattcttttagaacaagtatcctttagcaattcttttagaacaggtatcctggctatgaattcccttagttttcttttctttcatatgagaatgtctttatttcactctttcatatgagaatgtctttatttcacatgaaggctattttcactggatatgcaattcagggtcaatagttcttttctttcagccttttggcactttaaaagtgtgtaatttccttctgtctgtctgaatctgttttgtattgctatcatagaatacctgggtctgggtaacttacgaagaaagagatttatttggctcacaactctggtggctggaaaggttaacagcatggtgctggcatctgcttagcttctggtgagggccacgtgctgcatcacaagatagcagagaaggcaaaggggcagcaggtgcatgcagagaaaccaaacacaagagacaacctcactttataacaacccgctctcataggagctaatgcatttcagagagaactaatccatcagaactaatctagtctcacgagaaagacattaatgtatcttaacaacctaatcatatcttaaaggcaccatctgccaacattgttgcactggaaactaaggttccaatgtgagttttggtgggtatgctcaaaccatagcactggccttcacggtttgtgatgagaaatccatagtcattgaaatcactgttctcctacaggtaatgagccatttttctctcactgctttcaagatattttattttgccgttagttttcagcaatttgattatgtgtctggatgtggatttctttagctttatcctattgggggtttgcccatcttcttgactttatgtcttcacctaacttggaaagtttggggccattattgctttaaatatgtatattttttgagacagggtcttgctctgtcacccaggcctgtagtgcagtggcacaatcacagctcactgcagccttgacctcctgagctcaagcaatcctcccacctcaacctcccaagtagctgggaccacaggcaaatgccaccacgcctagctttttttttattttatttttttattttattattattattattttagagacagggtctccttatgttgctcaggctggtctcaaactcatgggctcagatgatcctcccgccttggccccctctgtagtgccgaaattacaggcttgagccactgccttcacccggcctcaaatattttttctgccccacactcctctctttctgggactccaatagcttgaatattagactttttgttgttaccccacaagttcctcagactgttgttgtttttcaatctttttttctctgtgttgctcaggtttcatattttttattgatctatttttaagttcactggctcttcactctgtcatctctattctgctgttgtgcctacccagtgattttttaaaattttatctttcagtttcaaaatttccatttgattagtctttatgtctcctcttttctattccaatactttccattttaatatttgtttcaaggatgattgctcattcaatcatttttataaagctgctttaaagtgcttgtcagattattccaacatctgcatcatcttattcttggcatctactggttgttgttccccatttgaattgagcatttcattattctttgcatgctgagtaattttggattgtatcctggccattttgaatattgtgtattcataatacataatatgggccttgtttaaatcatatgaagaatgttgatacatttgttttagcatgcaatctatacggttaggttcaggccacaagttccatcctgccttctgttggtgtgggttttttttccattcagtttttacagactttacagtgttattcaggtccatcccattgtgtaccacccagtagttagtctaggacttggacggagcattagctcagctcacagtctttggtatgtaaatcaggatccaatccatgcacatgaggtcaggagctggggaaagcaatgtcataaagttgtttatgaattcctgggctcaaccctaacctacaaaggccatttcattggagctctccaaggtaccaggtggatatgatggtccaggctggcctcctcctccccatccccaaccctcactgtggcctactagttgtctgatctctacttggttctttttcatccccatttctcaaaagagggtattgagagagcaacagggctggcacagggaggttcccaaggctccaaagagagtatagaggtctttattgaagaccctcagaagaccagggatgatccgaagcctaaaatagggaaccgtcccccaccgcaacagaactggctagcctcctaacccagtcacttccagcccatttctcaatcaaggtagaggggagaggagtggaatggttccagggagctccaggggccacagtggtgtgttctgagaagtctgaggaggagatcaccaggaattacaggtaatccaaggcccccagtgtggctctcttgccctctctggaactcctggacctgggaactcaatctattggggcacaggctctagctccactccccagtggtggaagcctccgccctgacaaacattaaagcccagcactatctgagtcttttttggccaattatctaaatggacatctagtcaaccaaacttctaaaaggaacagttggttgaatcaagacatctggtcaacctgtgaacccagacttatggtcaacccccaaatcagaacatcttatcaaatcacaaagcaggccatttggtcaatctgacttaccaaaaggcaatgcgccgtggttcctgagggtccctgcacatttgtgctaggcatgccaagaatgcgagtccctgaccactctttacagaggcagtggctcaatgagctcccttgagaaatcaggtaatatctccttccagacaaaagcagagcttgtcactgctcattataaaagcaatgaatccaccacattcagtgtacctctcctataacacaaccccactatgtgcgcacacatgcatctaggcccacctgcatacccctctgagacctgggggcatggcaaaccagcccaaacatcatgctgatactctggctactgcttttgctgtgaatagtataatcctttatctctgaccaaggaatctcttgtcttctgcttgcctccatgatataagacatcttgttggcttgaaaatagggtaaaacctcaatccctttacagttctagacattgattctcacccatcagacactgagtttagggtcctcaggcaggcactaacaccagactcctcacaccagacactaagtcctgccttccccctgccagatactatgtcgcctactactaggtccccaattcccccttcagaagctaactccacattaatagctctaggacctaagtcctactttatgcttcaaggctgagtcttgacctatcttgccagaaagcaagtcgggatctctgcctccagaggataagtcccaatttatgccaccagcactaggttccccgaatccccctccagggaccaactctcctccactgcccctacagatgctaaattctgatttcagctcccaagtctaagtccccacttcatagtcctgataggaagtctctaattttctctgcagaggctaagtcccaactgtcataagcattcactgaagctgtcttaccattcgacctcagcctggggattttgtgaccccatttctcatgcaggggagaaaggagaagagagggattgacagaggtagccctggagacttccacagagga[135 bp omitted]gaaactccatctctactaaaaatacaaaaaaattagctaggcatggtggtgggcgcctgtaatcccgcctacttgggagtctgaggcaggagaatcgcttgaacctgggaggcagaggttgcagtgagccgagacggcaccattgcactccagcctgggcaacaagaacaaaactccacctcaaaaaaaaaaaaagaaagaaaaagaacagacctaagggaaagcaggaacaataagaactctgagcagggatccccagccctctgtgtctgtctggtctttagataataacccaggcacctggtggccctatttcttgggtaaaggagtttggagggcagcaagactgacatgggaaaatccccaggcgctaacactaagggtgcccagtccctttagggaggacccactggggaacagaagcaaagccaaacaccagtacatgctttcccaacacaggtggctagacacacaacctgactcgggcacttagtggccccatctcttgggcagggaagaaaagaattggggagaatggcacagatcagcactggggttctccgtggtgagtgcagtggcctttcaggaggggcactacaggaactgagggcatctgatatcccaagaagcctccctacccactccatgcagccagccggctttccaataactaccagggacttacggcccagtttatcacatggaggaggctgaagagtgatggaaccccatgggatgaccccagtggccactgtgaggggggaagggaactttcagggagaccttctgtggaacaagggctctttgaaaacccatctgggctccatcctctccagccaattggccacctgcaatcgtcctggtcactctctcacaccatggtctggaagccagattgacttgctcagcccccaggggcttctgcataaagtgcaaaggcctttctgaaggtcccctccagatacctatctctaggtgtacaaaagccccagatcaagctcctcacacctcaggaggctgttttggggttttttgtttgtttgtttcgatataaggtcttgctctgttgcctaggctggagtacagtagtacaatctcagctcactgcagcctcaaattcctggccttaagcgaccctcccgagtagctgggactacaagcacacaccatcatgcccagctaatttttatattttttatagagatgtggtcttttcatgttgcccaggctggtcttgagatcctggcctcaaatgatcctcctgcctcggcctcttaaagtgctgggattacaggtatgagccactgcacccggccaagactaactgtgtgacccccaccccatggctttccagctccagctctcagcaggtgaggtcagagagaagtaggacaggcttgctggtcctttcgaggctcccatggagaacaggcatgctgggctcccaggctccttcctcagcaatcagcaggactagcaccagcaacctctggaggttatagaggcttttttttttcttttcttttcttttgagacagggtctcactctgtcgcccaggctggagtaaagtggcgcaatctcggctcactgcaacctctgcctcccagattcaagcaattcttgtgcctcagcctcctgagtagctgggattacaggcatgcaccaccacacccggctaatttttgtattttcattagagacagggtttctccatgttggccaggctggtctcaaactcctgacctcaggtgatctgcctgcctcggcctcccaaactgttgggattacagacatgagccaccatgcccagccaaatttttatatttttagtagagatggggtttcaccat[137 bp omitted]gtccctacctctagaccaagctcctccaactgcagcaggttaagcatgctatttcaagccagcctttactcagctgggagaaatcagatagcagctagaatgacttcatgaacacctgaaggcctccacagtgaagaaagaagccttttaggagggactacagcagaccaggttgggggtgggggcatccatcactgcatactgtgcttccctgtatgtagatagcttgctatttcgcatagtcccagttgtctccaatccccattcataacatggggacatcagagaggagcgagaccagcaccagaaggtcccacggatctgtgcagagggtgcagaagctgtttgtgagggacatctctgggaagtccataacagccaacacagagttcagaggccttttagaagaggtcttccatggaccgggcacagtggctcacgcctataatcccagcactttgggtaggccgaggcgggcagatcacctgagggcaggagttcaagaccagcctggccaacatagtgaaaccccatctctactaaaaatacaaaaattaaccaggcgtggtggcacatgcctgtaatcccaactaccaggaggctgaggcaggagaatcgcttgaacccaggaggtggaggttgcagtgggccaagattgtgccactgcacttcagcctgggcaacaagagtgaaactccatctcaaaaaaaaaagaagaggtcttccttggaatggaacgagggtgatccaaatcccctggatgtgctcctccaatcccagctgcagtcagctagttaaccaacctcaagtagggaaccccagccctgtttctaacccacacctaattctggccctaaccctgaaattgaacaactgaacattgacctcaacttaaacgtaaccctaacattaaccctgaccatgaacctgaccctcccattaattataatcctaaacctgattataaacctgactataaaccttaatgctaggccaggcatggtggcttatgcctgtaagcccagcactttgggaagccaaggcaggcagatcacttgaggccaggagttcaagaccagcctggccaacatggcaaaacccccgtctctactaaaaacacaaaaattagctgggcgcagtggtacatgcctataatcccaattactagggaggctgaggcaggagaatcgcttgaacccaggaggtggaggttgcagtgggccaagatcgtgccactgcactccagcctgggtgacagagcaagactccatctcaaaaaataaaaaaataaaaataaaaaaataaaccttaatgctaacgctgaccataaactagatcctaaatatgacctggtcatgaccctgacttcaaccataacccctaacttaaccataaacttgatctttaccttaaacatttccctgaccatgaagctgaccctgacctaaacctaaccagaacattgaccatgacccagaacctgccctgaccctaatcctgaccgtgatgctaaaccctaatcttgatatcgaaaactaacttgactcatcgtgacatcgattctgaaattgatactcaaactctgaccatgaacctgaccctaatagtgaaattaactgtttcctggccaggtgtcttgcctcacgcctgtaattctaacactttgggaggctgaggtgggcagatcgcttgagcccagcagttaaagaccagcctgggcaacatagcaagaccccatctctatttataatttaaaaatttttttaaaaaaaagaaattaactgttgccctggtcctgaaccttaccttgatcctaaacctaaccataaccctaacactaacattatcccttaacctaaccttcatgctgactttgtaggaaaatgtgttattctgactgatcttgtttatttgttttgtttcgtttttgtttgtttgtttgtttttgagacagagtctcgctctgtagcccaggctggagtgcagtggcgtgatctcggctcactgcaacctccgcctcccaggtcccagttcaagcaattctcctgccttagcctcccaagtagctgggattacaggctcaaaccaccacgcccggctagtttttgtatttttagtagagacagggtttcaccatgttggccaggctggtctctaactcctgacctcaagtgatccacccgcctcggcctccctaagtgctgggattacaggcgtgatctgtaatcacgtgcccagccgtgatcttgttttcgtatacactgtttataataacaagatttctggctaggtgcagtggcttatgcctctaatcctagcactttgggaggccgaggagggcagatcacttgaggtcaggagttcaaaaccagcctggccaacatggtgcaaccccatctctactaaaaatacaaacaaaaatagccgggcgtggtggcgggcacctgtaatcccagctacttgggaagctgaggcaggagaatcacttgaacccgggaggcggaggttgcagtgagccgagattgcgccactgcactccagcctgggccacagagcgaagctccatctcaaataataataataataataataataataataataataataataataatattttctccaattagccataagaagttactttgagaagaatgtgttattttggtcttttcactgagcttattctcacaaatactctgatttcatctaagtttattccaactcacagtaaaaagttactttgggaccaggcgcagtgcctcacgcctgtaatcccagcactttgggagaacaaggtgggcagatcacctgtggtcaggcgttcaagaccagcctggctaacatggtgaaacctgtctccactaaaaatacaaaaaaaaattagccgggtgtggtgacacatggctacttgggaggctgaggctgaggcatgagaattgcttgaactcgggcagtggaggttgcagtgagccaagatcgtgccactgcactccagccagggtgacagagcgagactctgtctcaattaaaaaaaataaaaataaaaacaaagagagaaaagttaattactttggaagaagaatgtgtgagtgattttggccaggcgcagtggcacatgcttgtgatcccagcactttgggaggccaaggcggggggatcacttgaagtcaggagttcgagacgagcctggccaacatggtgaaatcctgtctctactaaaaacacaaaaaaattagccgggcatagtggcacatgcctgtagtcccaactattccagaggctgaggcaggagaatcacttgaacccaggaggcagaggttgcagtgagccaagatcacgccactgcactccagcctgggcaacagagcaagactgtctcaaaaaaaaaaaaaaaaggaagaaagaaagaagaaaaagaaagaaagaaagaagaaaaagaaagagaagaaagaaaagaaagaaagaaaagaaagtgtgattctaagcacatctttacttataatgcttatgcttagactaatctaaatttgctcaaactttcaagaattggtttccttgccaaagaaggtgaggttctgagcttgttttaagacatgctgcttcttttcatctaattttgccctaactcacagtgggaaattacttttgagaagaatgtgtcattctaagcttgttttcatttatattgcttaattttacctagagttgcactaagtcaccatatgcagttattttttagaactatgtctgatcttgtgcttgttagtacatatacagcttagtttcatcttcacatactcttaactctccataagatattacttttgagaaaaaaattgtgattctgaatattttaaaataaagctcttagtttcacctagattaactcactataaaattttatttagggaaaatatgtgattctaagttattttatacataaattgcttaattttgctggatttattctaactcattgagaagttacattggagtagaatgtgtgattctgagcttgttttcacatcaattactcagtttcatttagatttactttaatcagttaagaattttttagggcccaagttatttgaaagtaaactgcttgaccgggcacagtggctcacacctgtaatcccagcactttgggaggctgaggcgggcagatcacaaggtcaggagatccagaccatcctggctaacatggtgaaaccttgtctctactaaaaatacaaaaaaattagccaggcgtggtgg[131 bp omitted]caaaaaaaaaaaaaaaaaaaaaggtaaactgcttagtctcatctagatttcttctaaatcatattgagatattgagaggctatactggagaagaatgtatgattcagatttgattgtcccaaagatggacagggatcagatttaccctcccacctgaaacaaccaaataaaccaaaaaaaaaaataaaatacatgaaacaacaggttttgaacaatggacagcaggcaaccaagggctgagagatgggaaacaaatgagatgaagagttaccattccccagtttactgccttttttttttttttttgagacagggtctcgctatgttgcccaggctggagtgcatgtggcatgatcacggctcactgcagcctcgacctcctaggctcaagggatcctcctgcctcagcttcccgagtagctgggactaaaggggtgcaccatcatatgcagctaatttttttatttaatttttagtagagacagcatctccctgtgttgctcaggctgatctcaaactcctgggctcaagtgatcctcctgcctttgtctcccaaagtgctaggatttagaggcgtgagccaccacacccggaagaccagtttgcccccttgagaaagtgttcaggctatggcacaagatgggagaactgaggtagagcccacctgactccctgagttgaggatttggagctaagacttctgggagatcaaaatagctagagttgatagaacagcgtaccagaaagcaaaaagctacacaaagagtgtgatggttaattttatatgtcaacctggctaggccttggaacccagatatttggtgaaacattattctagatgtttctatgaaggtagtttttaaatgagattcacattgaatcagtagactttgagtaaagcagattaccctccataatgcacacgggcctcatcctatcagctgaagaccttaatagaaaaagactgatctccccagaagagggaattctgccaggagactgccttcagactcacactaaagcatcaatgcttccctgggtctccagcttgctggtctaccttgaagattttgaactttgccagcctccacaatcatgtgagccaattccttaaaatctttggggatggatagatagatagataggtaggtagataggtagatatagatacatatatcctaatatatcccattggtgctgtttctctggagaaccctaatagacagagaaccctggagatctgaagagcatacccttcagtattcaaaagagtacttactgatcagtatatgcgtgtgaggaaactgcctggggccagggagagaacacctgaaaggattagagggaatagtgcctcatgctcacacagagccagtaatagtgcctgctcccaccagtcagattggaaaaaacgcataatttatgaggtattgggtagagtcctcaggaagttcttttctcagttgtggagaataattagccctacacaaagcactgctcgactccatcaaacagatcataaaagctagaccttaaaggataaaaatatttccaaggaaacttaactgcaactcaacaaagttcaagaagatttatattgaatacaaaaatatccagcacccaaaaagaaaaaaaaaatcacaatgtttgacatccaatcaaaacttaatagggccgggtgcagtggctcacgcctgtaatctcagcactttggaaggccgaggtgggtggatcacctgaggtcagaagttcaagaccagactgtccaaaatggtgaaaccctgtctctactaaaaatacaaaaaaattagccaggtgtggtggcgcattcctgtaatcccagctactcgggaggctgaggagaatcgcttgaacatgggaggcggccacatcagtgagccgagatggcgccactgcactccaacctgggcgacagagtgagactccgtctcaaaaaaaaaaaaagaaaagaaaaacttaatggggccaggcacaatggctcatgcctctaacccagtactttagaaggctgaggaaggtggattatttgaggccaggagttccagagcagcctgggcaacatagcaagaccctgtctctacaaaaaattcaaaaattagctaggtgtggtggcgcatgcctgtagtcctagtgtgtccggaattggtggtttcttggtctcactgacttcaagaatgaagccgcagaccctcgcggtgagtgttacagctcttaaggtggcgcgtctggagtttgttccttctgatgttcggatgtgttcggagtttcttccttctggtgggttcgtggtctcgctggctcaggagtgaagctgcagaccttcgtggtgagtgttacagctcttaaggcggtgcttctggagttgttcattcctcccggtgggcttgtggtctcgctggcttcaggagtgaagctgcagaccctcgtggtgagtgttacagctcataaaagcagtgtggacccaaagagtgagcagtagcaagatttattgcaaagagcgaaagatccaagcttccacagtgtagaaggggacccgagcaggttgccactgctggctcgggcagcctacttttattctcttatctggccccacccacatcctgctgattggtagagccgagtggtctgttttgacagggcgctgactggtgcgtttacaatccctgagctagacacaaaggttctccacgtccccaccagattagctagatacagagtgtggacacaaaggttctccaaggccccaccagagtagctagatacagagtgtcgattgctgtatttacaatccccgggctagacataaaggttctccaaggtcccaccagagtagctagatacagagtgtcgattgctgtatttacaatccccgggctagacataaaggttctccaaggccccaccagagtagctagatacagagtgtcgattgctgtatttacaatccctgggctagacataaagtttctccaaggccccaccagagtagctagatacagagtgtcaattggtgcattcacaaaccccgagctagacataaaggttctccaaggccccaccagagtagctagatacagagtatcgattgctgtatttacaatccccgggctagacataaaggttctccaaggccccaccagagtagctagatacagagtgtcgattgctgtatttacaatccctgggctagacataaaggttctccaaggccccaccagagtagctagatacagagtgtcgattgctgtatttacaatccctgggctagacataaaggttctccaaggccccaccagagtagctagatacagagtgtcgattgctgtatttacaattcctgggctagacataaaggttctccaaggccccaccagagtagctagatacagagtgtcgattggtgctttcacaaaccctgagctaggcataaaggttctccaaggccccaccagagtagctagatacagagtgtcgattgctgtatttacaatccctgggctagacataaaggttctccaaggccccaccagagtagctagatacagagtgtcgattggtgctttcacaaaccctgagctagacacagctagggtgctgatggtgtatttacaaaccttgagctagatacagagtgccgattggtgtatttacaatccctgagctagatataaaggttctccacgtccccaccagactcaggagcccagctggcttcacccagtggatcccgcacctgggctgcaggtggagctgcctgccagtcccgcgccgtgcgcccgcactcctcagcccttgtgtggtcgatgggactgggcgccatggagcagggggcggtgctcatcggggaggttctggcctcacaggagcccatggagggggtgggaggctgaggtatggtgggctgcaggtcccgagccctgccctgcgggaaggcagctaaggcccggcgaaaaatcgagcgcagcactggttggctggcactgctgggggacccagtacaccctccacagccactagcccgggtgctaagcccctcattgcccggggccggcagggccagccggctgctccgagtgcggggcccgccaagcccacgcccacccagaactccagctggcccgcaagcgccacgcgcagccccggttcccgctcacgcctctccctccacacctccccgcaagctgagcgagccggctctggccttggccagcccagaaaggggctcccacagtgcagcggtgggctgaagggctcctcaagtgctgccaaagtgggagcccaggcagaggaggcgccaagagcgagcgagcgagggctgtgaggactgccagcacgctgtcacctctcactaggtattctagaggctatttgggaggattgctggaactcagtagttcaaggaggcaatgagctatgatggcatcactgcactccagcctgagtgacagagctgaccctg[138 bp omitted]agtaaaaccccgtctctactaaaaatacaaaaattagctgagtgtggtgacgggcacctgtaatcccagctactcgggaggctgaggcaagagaattgcttcagcccgggaggcggaggttgcagtgagctgagatcgcaccactgcactccagcctgggcgatagggcaagactccatcttgggggggaaaaaaaagcttactaatcatgcaacaaggcaggaaaatatgaagacaacagtcaatcaaggaaaaccaacccagatttgatgcataaattaattagcagataaggacattaagagttattaaagctatgttccacaagttcataagagttcaacaagagacatagaagatataaaaatgacccaatggtgcaacatttttaaaagaatgaattttaaaaactgtcaacctagggagcaagatggctgaataaaagcctcctgatcatcctcttcacaggaatgctgaattgaacacctatccacacaataaagcaccttcataagaaccaaaaatcaggtgagcaatcacagtacctggttttaacttcctatcactgaaagaggcactaaagtgggtagggaagacagctttgaatcacctacaccaccccgcccccatcccctggtagtaggtgtgtggcagagagagagaatctgtgcacttgggggcaggagagcacagcaatcgtgagactttgcgctggaactcggtgcttccctgtcacaacagaaagcaaaaaccggagagaactaagccggcacccataaggggagcacttggaccagccctagccagaggcaaactgtccatcccagcagtcagaacctgagttttggcaagcctcaccaccgtgggctaaagtgctctgcagtcctaaataaacttgaaagtcagtctgggctacaaggactgccgttcctgggcaagtcctgttgctgtgctgggcttggagccagtggatttggacacacaacccagtgaaacatcagctggggtggccaagggagtgcttgagccacccctctcccaaccccaagcagtgcagctcaaaccactgaaagagattcctttcctctacttgaggagaggagcggggagagtaaagaggactttgtcttgcaacttggaagccagctcagccacagtaggatatggcaccaggcagagtcctgaagtccccattccaggccctagctcccagatgacatttttcacactttttttagaaggagtctcattctgtcacccaggctggagtgcagtggtgcgatctcggctcactgcaaactccgcctcccaggttcaagcaattctccctgcctc[134 bp omitted]cggcctcctaaagtgctgggattacaggcgtgagccactgtgcctggccccaaatgacatttctagacacactttgggccataagagaacctgctgccttgaagggaaggctctagtcctggtataattcaacatctgctgactaaagagcccccgggccctgaataacaaacagtggcacccaggtagtacaccatgggccttgggtaagacactgaaacatgctggctttaggtgtgacccagcatattccctgctgtggtggccacagggaaagaccccctctgcttgaggaaaggagaggaaagagtaaaggggactttgtcttgcagtttatgttccacttcaccacacgggggtagagcaccaaataggctcttggggtccctgattccaggccttggctcttagacaacatttctggaccttccctgggccagaggaaagcccactagcctgaagagtgagttgcaggcctgacagcattcacaacaagctgaataaggagcccttgggccctgagtgaatagcaatggtagccaggcaatatttgccaaggacctgggtcagttttggccatggagagagactcctttgcttatggaaaggggaaggaagagtgagaatgactttgtcttgtggcttgggtgccagctcagccaccataaaatagagtaccaggtagattcacaaggtttccgtgcccaggccctggctcctggatggcatctctaggcctgctcaagactggggaaacttgctgctctgaagggaaggacacaagccaggctggcattgccacctgctcattgtagagctctagggccttgagtggacattagtggtagccaggcagtggttaccatgggccttgggcacgactcagtactgagctggcttcaggtttgacctggtgcagtcccactggtggtggccaccggggtgtttgtgtcacctctcccctagctctaggtggctcagaacagagagagaaactgtgtgtttgggagaaagtaaaggaagagaacaagaatgtttccctggtaatccaaaggaatcttttggatcttatccaagaccacaaaggtggtacctctatgagtctacaagagccacagtgttattgggcttggagtccccccaatgcaaatatggctttgatgacaaaaaacatagatcacaacacccaagtccctttgaatgcctggaaaggcttcccaagaaggttgggtacaaacaagcccaggatgcaaagattgcagtaaatacctaactcatcaatgcccaggcaagcattatgaccacccaggaaaacatgaccttaccaaatgaactacataagacaccaggtatcaatcctggaaagacagagatatgtgacctctcatacagagaattcaaaatagctgtcttgaggaaactcacggaaactcacagatactcaagataacataaagaaggaattcagaatcctatcagataaatttaacaaagacattgcaataatgaaaaaagaataaagcagaaattctggagctgaaaaatgcaattgacagactgaagaatgcatcagagtcatttaatagcagaattgatcaagcagaggaaataattagtgagcttgaaaacaggct[142 bp omitted]aaaccccacctctactaaatatataaaaattagccaggcctgtaatctcagctactcagggggctgaggcaggagcatcacttgagcccaggaggcagaggttgcagtgagctgagatcgcgccattgcactccagcctgggtgacagaataagactccgtctcacaaaaaaaaaagaaagaaagaaagaaagaaaaaagaacaaaaaagaaagaagaatgcctacagaatccagaaaatagcctcaaagggcaaatctaaaagttattggccttaaaaaggagacagaaagagagatagggaaaaaagttttctgttaagggctaataacagagaacgtcccaaacatagagaaagatttcaatattcaagtacaaggttacagaacaccaagcagatttaaccaaaataagactaccttaggatatttaataatcaaactcctggccaggcgtgtcagctcatgcctgtaatcctagctttctgggaggctgaggtgggtaaatcacgtgaccccaggagtttgagaccagcctgggcaacatggcaaaatcccatttctttctacccaaaaaaaaacccacaaaatttagccagatgtggggtcatgcgcctgtagtcccagctacttgagaggctgagatgggaggatcacttgagctcaggaagccaaggctgtagtgagccatgattgcaccactgcactccagcccaggcaacagagcaagatcctgtctcaaaaataataataaaaccccaagggacaaggataaagaaaagaccttaaaatcagcaagagaaaagaaacaaataacactatggagctctaatacatctggcagcagacttctcagtggaaaccttacaagc[137 bp omitted]atggagaaaccctatctctactgaaaatacaaaattagccaggcatagtggcacatgcctgtaatcccagctactcgggaggctgaggcaggagaatcgcttgaacccaggaggcagagtttttcgtgagccgagatcgtgccattgcactccagcctgggcaacaagagggaaactccatctcaaaaataaaaaaaaaaaacaaaaaaacactaaaagatgtgccagttgaaaatgataactacgacagcatttcaagacatagtacaataagatagaaataggaacaacaaaaagttaaaaaatgggggatgaggttaaagtgtaagagtttttattagttttctctttgcttgtttgtttgtttgtttgtatgtttataccatcagtgttactttgtcatgagtttaaaataatgggttataagatatttgcaaggttcatggtaacctcaaaccaaaaaacatacaacagatacacaaaaaataaaaaagcaagaaattaaaacataccacctgagaaaaccaccctcactaaaaggaagacagaaaaaaggaaaggaggaagagaagaccacaaaacaatcagaaaacaaacaaccaaatggcaggaattgataaagctcaacatcccttcatgataacaatcctcaaaaaactgagtgtagaaggaacatatctcaacacaatgaaaccgtatatgatagacccacagctagtgtcattctgaatggggaaaaactgaaagcctttcctctaagacctggaacaagacaaggatgcccactttcaccactgttactcaacatagcactggaagtcctagctagaataatcagacaagagaaagaaatatggcggggcaggatgactcacaagtgtaatcccaacactttgggaggccaaggtgggcggatcaactgaggtcagttcaagaccagcctagccaacatggtgaaaccccgtctctacaaaaaatgcaaaaaaaattagctgggtgtggtggcgtgcgcctataatcccagctactccggaggctgaggcaggagataatcgcttgaatccaggaggcagaggttgtagtgagccaagatcgagccactgcactccagcctgggtgacagagcgagacttcgtctcaaagaaaaaaacgaaagagagagagagagaaaggaaaaagggcatccaaagtggaaaggaagaaatcaaattatacttttttgcagatgatctgagcttatatttggaaaaacctaaagactccaccaaaaaactattagaactgatgaacaaattcaggaaagttgcaggatacaaaatcaccatacaaaaatgagtagcatcgagacccccatctctacaaaagcataaaataattagccaggtgtggtagcacatgcctgtagtcacagctatttggagactgaggaaggagaattgctttagttcaggaggttgaagctac[133 bp omitted]aaccccatctctactaaaaatacaaaaattagctgggtgtggtggcatgtgcctgtagtcccagctacttgggaggctgaggcaaaataatcgctcgaacccaggaggtggaggttgcagtgagccaagatcacgccactacactccagcctgggcaacagagcgagactccatctcaaaaaaaaaaaaaaaaaaaaaaaaaaaagaaatgttacagaaatgcatcaagcaaaaggaaaattctccagttgtaaataaataaatggtaattatatggataaatatatgtattttctattatttaaatatttttaaaatataattggctccttaagatttacaacatatataaaagtggaacgcattaactaatagcataaaggctaaaaggagagagataaaagtataatattgtaaggtttttttatactacacatgaagtgatataccccttgaaagtggactctgataagttaacaatgtatactataaaccctatatgtataaatatagtaacaatatatactatatagtataacaatgtatactatataaggcaaccactaaagcaaaaaacaaagacttatagcttattagacaacaaaagacatgaaatagaatcataaatgtatttaattgatccaaaagaacacagaaaaaaattaaatttggaacaaagaacagacgggacaaatagaaaacaaataggaaggtgatagaatcaaatctaactaccacatcaatatgacattaaatataagtggtttaaacactccaatacaaaggcagacattgccagattggataaaaaagcaagaccaatctccatgccccctacaaggaatgcacttcaaatacaaagacgctaattaaaaaaagtaaaaggatagaaaaaatatatcatgctcatattttcaaaaaacttggagtgactattaatattgaaaaaggtcaatttcagggataaagaaagtcaagaagatattaagagccttaacatttatagcctgaaaacagagctcaaaatgcatgaagcaaaaactgatagaactgcaagaagatatagacaaacccacaatcatagttggagctttcaataagccttcgtgtttttgtttgtttatttgtttttgttttgttttttgtttttgagatggagtcttgctgtgttgcccaggctggagtgcagtggcgcaatctcggctcactgcaacctccgcctcccaggttcaagcgattctcctgccttagctccctcagtagctgagattacaggttcccaccaccatgcacagctaatttttgtatttttagtagagacggggtttctccatgttggtcaggctggtcttgaactcctgacctcaggtgatccacccacctcagcctcccaaagtgctgggattacaggtgtgagccaccttgccggcctcaataagcctccttttt[134 bp omitted]cagcctcccgagtagctgagatcacagatatgtgccaccatgcccagctaaatttttttttttaattatttttagtagagatggggtttca[132 bp omitted]gtagtcagtcaatatcagcaacgacatagtagacatgagcaacactactaaccaactaaaccttaataacatttgtagaatactccttcaacaacagcagaatacacattattttcaagtgcacatagaaagcttacaaacgtatattctgggccatcgacaggcctcaatacattaaaaaggactcaagtcaaatgagaaatgttctctgaacacattggaactaaatttgaaatcaataatggaaagattcttgtaaaatccccaaataaagggcttctacaaaaatcctacatctaacatcatacttaatggtgaaaaacaatgctttcctcgtaagatctggaataagacaggaatatctacacttatcacttctcttcaatattgtacccaaagttctaactggcttcaccagtgaattctagcaaacatttaaagaggaagaaaacactaatcctaggccagacacagcggcttacacctgtaatcccatcactttaaggaggccaaggcgggaagactgcttgagccccagagtttgagaccagtctggacaaaacagcaagaccccatctctacaacaaattttaaaattagccaaatgtggtggtgcacacctgtggtcccagttattcaggaggttgaggtgaaaggattgcttgagcccaggaggttgaggctgcggtgagccatgttcacaccactgcactccagcctgggcgacagagtgagaacctgtctcaaaaatacataaaacaccaatcctacacaaacttttctggaaaagatatcacagacctgaggttgcacaaatagtataaggaggaatttattgcatcagaaataattttatatgaaggaatgtatcctctccttctggacaaactcatcttttcccaaagtctcaacaaccatccacttttatttttcttgagatggagtctcactctgtcacccaggctgaagtgcaatggcatgatattggctcattgcaacctccacctcctgtgttcaagcgattctcatgtctcagcctcctgagtatctgggattacaggcacctgctgctacacctggctaatttttgtatttcagtggagacagggtttcaccatgttggccagctagtctcgaactcctggactcaggtgatgcacctgcctcggcctctcaaagtgctgggattacaggcgtgagccactgtgcccagccacaaccatccacttctgaacatgcatcccaggcccctctgcagagcccagacacacatatccaattgcctactggatattaccaatgggatagatagatagatagatagatagatagatagatagatagatagatagatagatatacccagaatgtattttttctgtccattggcactccatgagggcaaagactttgcctgtcttgttcccacctgtatattcagtgctcaagatacacagtagctgactaagagtttagttcctattcaagaaataccttcctgcaaagaaaatagcccagagggctttgcagttgagttctacgaaacactcaaggaacagattactttagtactgcataaactcttacagagaagcggaaaaaagaggcttaaatctccaattcattttaagaggatagtgtattagctccatagaagtgccattatagacgaccaccaactgagtggcttaaaacaacaaaaatttattctctcacagttctggaagctggaagtctgaagtcaaggtgtctgcagggccgtgctccctctgaaacctgtcggtgaatccttcctctcctctcctagattctggtggtttgccagcaatttttggcgttccttggcttgcagctgcaaaactccaatctctgcctccgtggccacatggcattctcccagtatgtttctgtcttcacatggccatcttcttataaggacatcatcctaactaattacatctgcaacaaccttatttccaaactttacataagatcatattctgagctactaggggttaggacttcaacatctttttggcggggaacacaattcaacccataaaagatagcataacaaacaaggatcacttgaggccaggaatttaagaccagcctgggcaatatggtgagactctgtctgtaaataaataaaaatttagccagatgtggtggcgtgcacctgtagttccagctactggggaggctgaggtaggaggatcacttaagcccaggaattcaaggctgcagtaagccatgatcgcatcactgcacttcagcctgggcaatagaatgagaccctgtctctaaaaaataaaagtaataataaaatttttttaaataaaggaaattttcaggtttatctccttcatgaacatagatgcaaaaatcctaaatgaaatactagtaatacataaaaatgttaatatattataaacaataaacaagttgggtttattcctggaatacaatgttagtttaatattggaaaattaaataatgtaatttacttttttttttttttgagacagagtttcgctcttgtccccaggctggagtgcagtggcatgatctcagctcactgcaatctctgcctcccagtttcaagcgattcgcctgcctcccaagtagctgggactacaggcatgtaccaccacacctggctaattttttgtatttttagtagagagggggtttcgccatgttgcccaggctggtctcaaactcctggtctcaagtgatccacctgcctcagcctcccaaaatgctgggattacaggcatgagccaccttgcctggccaatttaccatatttacagattaaaagataaaactcttgtggttgccaagaaagacacagaaaaagcatctgacaaatcttaacatccatttataatttttttaattaaagaattagccaggtgtggtggtgcacacctttagtcctagctacttaggaggccaaggggggaggatgacttgagcccaggaggtcgaagctgcagtgagctatgattgcatcactgcactccagccagggtgacagaatgagaccctgtctaaaaaaaaaaaaaaaagctgagcatgatggctcacacctctattcccagcatcctagccctttgggtagctgaagcaggcagattgcttgagtccagaagttcaagaccagccacgggcaacatggcaaaacctcgtctctacagaaaaaaaaaaaaaaaaaaattagctgagcatggtggtgtgagcttatcctacctacttgggaggctgagatgggaggatcgcttgagccctgggaggtcaaggctgcagtgagcagtgagcaatgatggcgccactgcactccaacgtgggcaacagagcaagaccctgtcaaaaaaacaaactcctatcaaactaggaaaagacaggactttttttttaacgtgatagtctctacaaaatatgttctcaatgggaaaagttgaaagattttcctttaaatcaggaaaaagacaagggttctagtatcaatattgccattcaacattgtactgaaattagccgggtgtggtggcaggcatatgtaatcccagcttctcaggaggctgaagtgggagaatcgcttgaactcgggaggcagaggttgcaatgagccgagatcacgccactgcactccagcctgggcgacagagtaagactccgcctcaaaaaacaaacaacaacaacaaaaaacacattgtactgaagaatctagccagttcaggaaaactagaaaaagaaacgaaactttaagaatgagtagtctgtggaggtcagtgattgtggagggcagggggcatctgtgaggctcaggtcaagagctcaggctgcaggatgacaatgtcagggttacttaaaataaagctcctgaatatttcagtgcgcatcctgggcaacctacactgcctaccctctgctgacaagattacaaacttctctgctgacaagattacctgcctaggccgaaaaccaggagatctgtcctaggactgtctccatgctagcctttctctgagtcaaactgtgaacctggtaggacacgtgaaggtcggatttgtccgagggagtggaagtacctcacaggatacatggagataggatttaccacagagaggtgggggagcagctgccctgcagcaaagccagtccccattcatgatctccccacctctcgccctgcaagtcctgaatccacaggggtgtatcccagtgtgtcactgcccctattcccacaaatcttctatggctttgcgctatggaaaggactttccacaacaatactaggacattgtatatattatatactatatatattacagtattatatagcatatgcattctatattatctccattttctagataaggaaacttctgaggctcagaaggaatcagaaactcgaccaaggtcatactatgttagtaagtagtagagctatgtaccaaataaatgtaggtctgaatctaaagggagactattacctaaaaaattcaactctgtgctttcctggagacccattcccacctgcctggggcagctgtttcccacagggtcctccaaagtctccaaacagtaatcacacataggcccaatcactgaccctccaagaatccaattaaggaaccaaagaaaccacaatcaaggccgggcactgtggctcatgcctgtaatcccagtgctttgggaggccaaggtaggggacctcttgagtggaggagtttgaggctgcagtgagctatgattgaaccactgcactccagcctgggtgacagatcaagaaagaaagaagaaagagaaagaggccgggggcagtggctcatgcctgtaatcccagcactttgggaggctgaggtgggcggatcacttgaggtcaggagtttgagaccagccaggccaacatggtgaaacctcatctctactaaaaatacaaaaattagctgggcgtgctcgcttgaacccaggaggtggagcttgcagtgaactgagattgtgccattgcactccagcctggacaacagagcgagactctgtcaaaaaaaaaaaaaaaaaatagagagagagagaaagagaaagaatgaaagagagagaaagagaaagaattagagaaagaaaagaaagaaagaagaaggaaggaaaggaaggaaggagggaaggaaggaaggagggaaggaaggaaggaaggaaaagagaaagaaaggaaggaaggaaaagagaaagaaagaaagagagagagagaaagaaagaagaaagagagggagggagggaggaaggaaggaaggaagcacagagcgtcactcatcactggctcacacgaacactaccactatggcccctctcccaatgattgacagccacagaccctcaatcagtagcctcaaaggcctccaattattaattacctcaggattcgagtccctggagcctcatcctgacaccactggcaaccaatcactgatcttccaaaactgtggccagaccatagagactgtcagagcataaagaaaaatccctccactgttgattgtcagggtctgcgaaaggtctgagacttcaccctcttacaagctaacatgttttagagatgctgacagaaaacatgagactcctgaggctgagacaaaggattttcctgctcctaggacagcaagcagcttgcacgtcacgtgggcacctgctccccatgtcctccaagtcccacagcagtgatgcagagggtccctggtggacattgcacacacaataggtttacatcacagccaagaaacactgagcatgggtgatccagcctgttttttgccccagagggagacattgcctcatcccacagggttgctcggtgtcatcacaaccctgagaaatggctggggtaatcagtgattggggccttgtatctttaggcagctacaaagtagtaaaactaaggccaggttactatacgctacaacccacacaaaggaatttagactgatgcgctgacgtttggcatactgtcaataatttagggggcaatacatgggccccaaagcaaaccctgtcccagtggagagacattctgttacctactgttccccccatatacaaatataccatccaaaggggaacagttcatttcacttcagcatttgttgttcaacttgattggactcaccattacattggtttggtaaagtgttatgagcagtagtctattcaggctgctataatggaatacaatagacagggtagcatataaccaacaagtttatttctcacacgtctggaggctggaagtcgaagatcaaggtgccagcagatttctgcatctggtgagggtccacttcctggttcacagatggccatcctctcactgtgtcctcacatggagaaaataacaagggagcactctggggccccgtttataagggcactaattcctttcatgagggctctgccctcaagacctaatcacctcccaaagaccctaccttctaataccttggggcttaggattccaacatatgaattttgaggtaacataaacattccacctatagcaagtagcatcttagtgcttgtacttaaatctctaaacgtggcataatccaaggccacttgggtgccaggagaagcagatgaatttggatcaatcagatctaaacaaggttgtgctggcccacgtatgtctacaggtatgagggaagcctgtgtttaggagctgctgttgatggcatcaggcacagcagagtaattcaggagcagccatactcacatgcttttttctggttttgtcacccaaggacggtgatggcaaacctagcagcaggttagattgccagctgcacctgctgcttgactccagcagagcagatgattgttttgttgggctgtgagtgctcgatctaggggacaaagagagcattcattttctccccatcttgcacctctcagggtctaagatattccctccctgtattagtccattttcacactgctataaagagctacctgagactgggtaacttacgaagaaaagaggtttaattgactcagagttctgcatggctggggaggcctcaggaaactcacgatcatggcagaaggtgaagcagaagcaagaaccttcttcacaaggtagcaggagagaaagcgagggaagaaagccacccactttttttttttttttttttttgagacagggtgttgctctgtcacccaggctggagtgcagtggcgtgatctcggctcactacaacctccacctcccaggttcaagacattctcccgcctcagcctcctgagtagctagtaccacaggcacacaccaccacgcccagctaccttttgtatttttagtagagacagagtttcaccatgttgcccagggtggtctcaaactcctgaactcaggcaatctgcccaccttggcctcccaaagtgctaggattacagacgtgagccaccgtgcccagcaccatgcactttttaaaccatcagatctcgtaagaactcattcactcactatcacaagaacagcatgggggaaactccccccataatccaatcacctcccatcaggtccctcccctgacacagggggattaccattcgaagtgagatttgggtggggacacagagccaaaccaaccatatcactccccaaatgctctccttccacacctcatgaaatcaatgtatcccatcccagagcctgtaacttcactttttcccaatcatcccctatttgtacccagacctttcatccagaagggtcaagtacaagagggccaaaggcatttttataaaatttacagagattttttttttatgtcttctatcttagtcagtgtgagctgctgtatgggaacttggtgagtggtgtactcaatcaagtggtcattgtcattaggatctaggaccgtgtccacccaacaagagaattcaggtgactgaccagaattaactttaagtccgagccaggcatggtggctcacacttgtaatcccagcactttggggggccaaggtgggcagatcacctgaggtcaggagttcgagaccggcctggccaacatggtgaaaccctgtctctactgaaaatacaaaaattagccaggcgtggtggtaggtgcctgtaatcccagctacttgggaggctgaggcacgagaatcacttgaacccaggaggcagaggtggcagtgagctgagattgcgccactgcactccagcctgggcaacagagcgagactcagtctcaaaaaaaaaaaaaaaaagtttaagtcccctagggctcttttgggctgggctgctgcctggagggttaccaactaggctagcctggaacctgtgattactgttaaaggaaagaaaaatacatcacgtccaggaacggccagggcagaatcccaaatgcctctatagcccaccccttttgttccgaccattatctgaggtacccaatgggagataatgccattcttgggacagccacatttagtgaccaaactgccttactaaggtgagtggaccaggagaaggagagagaggtaggttctgcaatccttttgagttcatttttgaggaggccatttcaatatttaacaatatcagatacctgcccatggtagggcacatagaacatctatggaaggctttgactactgacccatagttgggtggcctttgcaacaaaaggcacaccactgccagactgcaaatggtctgtgtcagaaacatagagtcctttactttgtgcccagtctatgatggtggatgcattgccatgttcagggggcagtgaactagaagtgcatcagctgtttgattccagtcggcctcatcagagaataggctcttactatgggcgtctacatgggtgacccagactgaccaattccaccagtagctctctacccgcttatctgttaaaaaggcatatgatgttttaaaacgtttgaaagtctcagctttagaacagtttagcttttccactaaccatctattactgatctccacagaccccaatattgtccctagaacccttccatcactcaccccagaaatcttctatcagaaacacccgccctccattgtagcctctcaggcctaaaatctcaaatcaaattccaatcctaggccaactccccaaccctaagactgccttttctggggcggctcttttttcacaggtgcagtgaggccatcgtttctgtacagcgcggaaaagctaaactgttctaaatctgtgactttcgaattttttaaagcatcatatgccttttaaaaaacagataaggccgggcgcggtggctcacgcctgtaattccagtactttgggagtccg[134 bp omitted]gaggcacgagaatcgctggaacccgggaggcggaggttgcagtgagcggagatcgtgccactgcactccagcctgggcgacagagctagattccgtctcaaaaaaataaaaaatataaaataaaaaacagataagcgggtagggagctaccggtggaactgagtttcctctttaagggaaacgaggacaaggacaagatcccgtcttttctgcactcagtcgccccgcccccaacgcaagtaggcatgtttattggatgataagagggtcagtcaaagtaaggaccaaccctctactgccaaaagacacatactactcaagggcccctgactcagacgttctcactggtcggaaatgccatcaatcaagtttcaatccccgcccccttctcgcggaagaactatgggtgctaacctctctctcaggcctgctgtcaatcggctccgcatcctctagttctgcacatccccggccatcagagcacgaacttctggtcggtccgcctgccgttctttcacctatagagcccaccctctaaaggtgtccaagctgctccaaagaacaattgattaacccaacggctgtctttggccctcagaactgtcacacctggctccgcctcttcccggacatcatctgttgcaccagagactggcgggtctggaaagaagctctgagcccatccgcgtttctctgttggaccctgtcaggtctcttgttccgtgtccaatgtcagtcgggtagggaggcagtggggcagtcttggttctcatcccaccccggagtctctgcgcagccacaattcaggaaaacaatctggaggcgggttcaaaacactaagattgattgaacgcgctgatggtttggttttctcctatagcgctttggtagtggcttttatccagaccgccccccccccacccccccggaatgaaccctggtatagaaatgttacccgtatgtgtgcatatgattgtttttaatatatttcaatttgatgaatcagcctttttcaaggtcagattccagaccgacccttctggcgcccaccccccgcttttttttttttttttttttttccaaaatgaaagctttcccaaagaggccacgtttgtagggctagtggaattttttggaaaagggagaaagcggattctggatgaggacaatggtggcccagaagtcgctatgacttaagagtcttggcagaggcagaggctggggaaagcgagcagtgtttttcatttaggtggcatctgtacgaatcctagtttggaaaggtgcgaaggttatgtgcctttgtttttaatattttggatttttaattttctgtttctttttttcacttagtttttatcttcgaagtttaattttgctgtttttttatttcatattcttaaaaattgtataattaaattttattgctactggcttttaattaattcattaattaattttgagacggagtctcgctctgttgcccaggctggagtgcagtggcgcgatctcagctcaccacaacctccgcctcccgggttcaagcaattctcctgcctcggcctcccgagtagctgggactacaggcacgcgccaccatgcctggctgatttttgtatttttagtag[155 bp omitted]ggctttttaaattaaaattacaagaaaatgtattgattcctctggtgttaacaggtctggagacatacatttatgatgctttggagctattgataatatatagagtactttattcattaattatttcattctaaaaaccctgctttatatatccccagaatactaaggcctggtggggaatatcttataaataattaatggttattactaattattaataataaccgtcaatgaaagtaagatagaaactgttaagagattcagttaagtactgtgtaattttgtgttgattatatctgccagtaatattcatcatgcattgcatagaagtgggattgtctttctttttctcctagctggtttgtgagaaaattgtgagcaattttgcacagggagacttcgatgtctgactaacatttattgactgcttgtatgtactaggaataattctaaatgctgatcatgtgttatttttttctctttttttctttttatttgtcattctaaatgcccttcatgtattgtctcatttaatcctcacaaataggcacatttattctcgtcatactacagatggggaaacatccgtaagtggcagagatgggatttgaacccaagccgtcttaaggactgcactggaacggtgttttttgttttctaaaatgggggtaataatacatgtaaagtgattagaacatatagttagctctgaatacatggcagaacttactgcagttatggccttgtttaaggctcccagccaccctgtgagttagggatcaacatgatcccccttttctacaagaagaaacaggttctgagagaataaatgacttgcccaaggccactcggtacatggcctagctgggctcatgctgtggtcattttcctgctataaacccttcccaagttccacaccctactctggatgaactcttggtgcattaaggcttttgattcataaaatttaaatatatttctaagctgggtacggtggcatgcacctatagtcccagcttctcggggggcttaggtgggaggattgcttgagcccaggaattcaagtccagcctgggcaatatagcaagaacccatctctaaaaataaacaaataagtttctgaacacacacatgtcaaacccctgtgtgatctggccccaacccaccagtcctgccttatcttaatggatttaggggtttttaaaatttatttttattttattagtattatttcagtagttttgggggaacaggtggtgtttggtcacatgaaaaagtcctttagtggtgatttctgagattttggtgcacccatcatccgatgtggagttttttacccctcacccccttcccaccccctccccccagtccccagagcccattgtatcattcttatgcctttgggtcctcatagtttagctcccacttgtaagagagaacagggcggacgcgatggctcacgcctgtgatcccagcactttgggaggctgaggcgggtggatcaattgaggtcaggagttccagaccagcctgaccaacatggcgaaaccctgtctctactaaaaatacaaaaattagccgggcctagtggtacacacctgtaatcccagctacttgggaggctgaggcaggagaatcgcttaaatccgggaggcaaaggttgcagtgaaccgagatcacgccactgcactccagactggacgacagagcgaaactccatcttaaaaaacaaaacagaacaaaaaagtgagaacatacgatgtttgcttttccattcctgagttacttcatttagaatataatggtttaaaaaaaaaagaatatgatggtttctttccttcctccctttcttcctcctcctcttcttctttctctctctctctctcgctctttctctctcagtaaaataacctaatttatttttttaaattcccagtaccatgtcttaaacttatgagtaaggaaaataacgattgttattcggggtgatgcccgaatcctcactgctaatgtgagacgaatttttgagctggtaaaggtcgcccctaaggtgaccagcctactttgcgggatgcctaggagtcgcgatctgcctgacacctttacacctaaaaagtagactgggggcctggcgcggtggctcacgcctgtaatcccatcactttgggaggctgaggagggcggatcacgaggtcaggagatagagaccatctggctaacatggtgaaactccgtctctactaaaaatacaaaaagaaattagccaggcgtggtggcgggctcctgcagtcccagctactcaggaggctgaggcaggagaatggtttgaacccaggaggtggagcttgcagtgagcctagattgcgccactgcactccagcccgggcaacagagcgagactccgtctcaaaaaaaaaaaagaagtagactggggccgggtgccgtggctcacacctgtaatcctagcattttgggaggccaaggtgggtggatcgcttgaggtcaggagttccagaccagcctgaccagcatggtgaaacccggtttctactaaaaatacaaaaattagttgggtgtcgtggcacacacctgtaatcccagctgctctggaggctgaggcatgagaatcacttgaaccccataggccgaggttgcagtgagctgagatcgtgccactaccctccagcctgggtgacagagtgagaccctgtctcaaaaataaaaaaaataaaaaatttcccagtaccatgactataactaaaaggacaccatgcctaatgcagtttgtgtgtgatatgcagggaaaacatttggagagtgagtaataaaaggggattggaattttaaataaggaaagtccactttaagaaggtgatgtttaccaacgacttgaaggaggtgaaggagttggaaagaaaacaaaaagacaaggctggctgggcacagtggctctcacctgtaatcccaacactttgggaggccaaggcggggagactccttgagcccaggagttccagactagcctggggaacataacaagactatggagactatttttttttttttttttttgagacagagtttcgctcttgttgcccaggctggagtgcagtggcacaatctcggctcactacaacctccacttcccggattcaagcaattctcctgcctcagcctcccaagtagctagcattacaggcatgtgccaccacgcctggctaattttttctattttttgtagagatggtgtttctccacattggtcaggctggtcttgaactcccgatctcaggtgatccacccgccttgccctcccaaagtactgggattacaggtgtaagccaccatgcaggaccaaaaaaatctttttaaaaaagaacaaataataatttggggtaatgataatagctaaataagtaaatatataccacttttttttttttttttcgagacagggtctcactctgtcacccaggctggagtacagtggcataatcatggctcactgcagcctcgaattcccgggcccaagcaatccttccacctcagcttcccaagtagctggaaccacaggtgtgcgctaccacctgggtaattttttaaattttcagagacgaggttttgccatgttgcccaggctggtctcgaactcctgagctcaatcaatctatccgccttggcctatcaagtgctggaattacaggcatgagccaccatatcctgccccaccactttcaataacagagccaaaacttcgaagtagtgactgccagggttccaaaaccaccttccattttggggtccacaatttgaacattccccaaaccattgtcccacaatctcatttttgaagaagttttttttaatttaaaaacttccatgattactgtattaatatgaagattaattcattcagccagccaatgtttacaaacagctaatctgtgtcaaacaacattgtaagcactcagattaatcctctcgatatccttacgaggtagttaacatcattagccccagtttacagagggggaaaataggagtatgaggtcacacatttagtatggaggaagctgggatttgaaccaaggcagtatggctccaggggacgttaccctaacccctgtgttagactgtcttgaaagttttactcgtctttcaaagttctctcttcaattagacacttccctcagatcttcatcaaacgtcatttttaaatttaatttttttttaagagatgggggtcttgctctgttgcccagggtggaatacagtggcagggatcatagctgactgcagccttgacatcctgggctcaagggatcctcctgcctcagtagctaggactacaggtgtgcgcgcacatacaaacacatacacacaaatactatattcttccctgcttcatttttctcctcaacatatatcactatcatattatatattttacttttttttttttttgaggcagggtctcactctgtcacccaggctggagtgcagtggcacaatctcagctcactgcagcctagacctctgcgatcctcccacctcagcctcccaagtagctgggaccacaggcacatgccaccatgcttagctaattttttgtatttttagtagaaatgggggtctcgccatgttgcccaggctggtcttgaactcctgagctcaagggatctgcacccctcagcctcccaaagttctgggattacaggcatgagccatggtccccagcctgtattttacttatttagctattatctttactccaaattgttaattattctttaaatttattatctgtcccctacagataataaataagcttaataaatcaataagcttccttcctcttgaaggaagccccaagagggcaggaatttttgcctgttttattcactgctgtatccctgtcacatagtaggcacttgatcaatatttgtgagatgaatgaataaatgattgaatgaacaaatgaatccttcttcacacttatgtataggtaatggttgttgattcccagctgctttgcctgggtcctgcgccttcaactggccctggattcacccctctgactcacatgcacttgacctctaaagtattggctctgcttacgaatactaacatttaaaattggaatcaggccaggggcggtggctcacgcctgtaatcccagctctttgggaggctgaggctggtggatcacttgaggtcaggagttttagaccagcctggccaacatggtgaaaccccgtttctactaaaattacaaaaattagcccagcatgatggtgctcaactgtagtcccagctacttgggaggctgaagcacgagaatcgcttggaccaagaaggcagaggttgcagtgagccaagatcgcaccactgtactccagctgggatgacagagtgagactctgtctcaaaaattaattaattaatttaatttaatttaattggaattaaggccagtcgtggtggctcatgcctgtaatcccagcactttgggaggccaaggcgggtggattgcttgagcccaggagtttgagaccagcctgggcaacatggtaaaaccctgtccctactaaaaatacaaaaaattagccaggcatggtagtgcacgactgtagtcccagctactctgtcagctgaggcacaagaatcgcttgaactcgggaggtggaggttgcagtgagccaagatcttgccactgtactccagccagggcgacagagcgatactccatctcaaaaaaaaaaaaaaaaaaaaaggccggggcggtggctcacacctgtaattccaacactttgggaggccgaggcaggcagatcacaaagtcaagagatggagaccatcctggccaacatagtgaaactgtctctactaaaaatacaaaaattagctgggtgtagtggcacgcacctgtagtcccagctactcgggaggctgaggcaggagaatcacttgaacccgggagacagagattgcggtgagccgagattgtgccaccactgcactccagcctggtgacagagcaagactctgtctcaaaaaaaaaaaaatttaaaaaaaaattggaattagaccaactcaactcaggtgaatttttactgagcaactttgaaccggagtgaattctcctgagccaatttaattccttgatcaatgccatacagtggtgcagttaacccaaaaccaattttggctgtctcatttctctgaagttattttcatcgtgatcattttctggttaatttttgcaacgatgattcaatccatacattgattctcttatctgtgtcaaattcaagcagtaacagcttccctcagatagctccttggcctcaggctgctccttgaccatctcaggcacatacattcttgcttctggaacttggtacttattgttccttctgccagaaatgctcttgcatctgtgtagttcatctctggcttccttcacatttttttccttcaagtaatcacctttgctgactatcctatttaaattcaggttctcctctccccccaactccctgacaccccccttaccagatttacttatttatttatttttgggatagggtcttgctcggtcacccaggctggagtgcagtggcccgatctcagctcactgcaacctttgcctcccgtgctccagcaattctccacctcagccttccgagtagctggaattacaggcgtgtgacaccatgcccagcccag[137 bp omitted]ctacatacatataacacacaaattgtgctgtttattttctgtctctcccagctggaatacaggctccatgagggcgggcatttttaaatcttttgttccctgctgtatcccctttgcctgtaacagtgcctgggcaggaggatcgcttcagtccagggtccaggctgcagtgagccatagtcatgccactgcactccagcctgaccaacagagcaagaccctatctcaaaacaaaaataaaaacaaaacaacaggaacagtgcctaggaccctgtaggcacttcaataaatatttgttgaatgaatacctcctgtcattctgagctttatttgtggacagtttccattgagtctaatatttcaggatcaaaatttgcaggtccacattttgttgagaacatcaaaaacttccatcaattttccctcaacacagtttcaggttcacagttttggctgctgtcagtttattctgtggtgcttatgtttattggtaatagtcactgttaatctggtaagatgttctatttttattttctgggtgatgtcctattagattgaaggataaaggaggccagtatctattatgtgggcagaacaaagttgcgtccaaaatatgaaagttcaaaggtccctggggtcgaacagtagggtgaaaacattgtattaaggtctctgatcactcacaccagcctctgccctcatcctgggaaattcctaagggcagggaccctgatatccgccagtgcctggcacactgttggggcttggcactcagtaggcactccctccctcttcatcccaatgtggtccttaaaaggtcagtcatccccagcctggccaacatggtgaaaccctgtctctactaaaaaaaaaatacaaacaaaattagccgggcgtggtggtgggtgcctgtagttccagctactcaggaggctgaggcaggagaatcgtttgaacctgggagaaggaggttgcagagagccgagatcatgccactgcattccagcctgggcaacagagtgagaccctgtctcaagaaaagaaaaaaaaaaaggttagtcatccgccagaatggctgcagtgaaaaagatgggaaatgccgaatgatggggagtcaactctgggaaagtgtagattggaaaattggcatgatttactgaagctgattggtcacatgtctacgcaatgacttagcaattccattcctaggttatatacccaagaaatgagtacatatgtctatcaaaagatgtgtacaagaatgttcacagaattattcttagccaggcacagtggctcatgcttgtaatcccagcactctgggaggccaaggtaggtggatcacttaagatcaggggtttgagatcagcctggccaacctggtgaaacactgtctctactaaaaatacaaaaattagctgggcctggtgggtcacgcctataaccccagctactcgggaggctgaggcatgagaatcactccaacccagggaggtggaggttgcagtgagccaagatcgcaccactgcactccagcctgagcgacagagcaagactctgtctcaaaagaaaaaaaaattcttaatagccccaaatataaaacaactcaaatgctcagcaacgtaagaatggctaaagtctggtctgttcatacaatgaaatggaatacagcaatgaggatgaacaaactactcatgtatgtgacgatgttgatcagtctcacaaacgttgtacagaatgaaagaaactggacacaaaaccagaccaaagtaacctaacattgttagaagtcaggagagtggctacctttggtggggaagagggaagacctgaagggagcttctggggtttgccatgttgtgatttttgtttgtctttttgtttttgagacagggtctcgctctgtggcccaggctggagtgtagtggcacggtgcgatctcggctcactgcaacctctgcctcctaggctcaagcgatcctcccacctcagcacccttactagctgggaccatcatgcctcgctaatttttgtattttttgtagagacgaggtttcaccatgttgcccaggctagtctcaaactcccaagcttgagacaccagtctgcctctgcctctcaaagtatgtttcttgacctgagtgctggttatatgggtgtgcccaatttataaaaagtaaatgagctttgtgagcttttctgcatgtgtattttaattcaatgatttataaagagtcagtcagtgtggctgggccatgatgagggaggggaaggtagtattgtcagaatggggccagggctcggattttaggattaagtctaagtgcagccttctgtttgaccagaatggaggcttctggagagccctggagcttgatgaggcagagcagaagggaatgagaagtgttcatcctcaggggggtaagccagaaggcaaggatgggtatgggatgtcacctacacaggaggtatcaataccaaatgtttatcaagcacataccatgccagtcactgctctaagtgaacagaacatatgtgaatacctgcccttctggaatttacatcctggtgggtggtgagtggagagaatgtgctctctaggcaccaggctgaggcttattataggggttattgcaccaatatacccaggtacttggtggctggggtaacatgcccctttcacttccatagtcccactaactgcagggggagggtagagagtgctccctttatacattagtactctctgctttggggtacactcgagttgggagactggccccacaaagcagcactggggcaggggaagccctcagggtcttcctcacttgcaggaaggctcatgcagatatggctcccgcctcagccacatgtaagtggatttgggttctcctgagacccagtagctagaagtagggcattgcctctagtggtgaatttggcaagccagattttcttcctgtagccagtggctggaggctcccacaccctccaaagccccaggcagggacaagcacagagatggtagcaatgaatatatgaggtggtgatttgaatgtgggagctgtggaaggaagagatgccaagagggtgaagggaagcccacacttaacagagatgcttttgaaagaaacaaactcagccagggccagaacaagtcccctactccatctgccagactgagagacagcaaccctggtgcaaggagacagcctatttccacagaggaagaaagtaagggagaaaagacttcttgatttcgagacacagaaagacaaagagaggaaagggggtgaggagagaaacagacacacgtgcacacacatacacacacacagatgcatatcttgagttagaggtcatccagatttggggcagaagggaatacaggcatccagactcaccaacacacaggacaggggcaaaccctaaagcccagagagaagcagagaggacagggaggggagacaaaacacccacccttagaaagagaaagccctgcactcaccctccaccttaatccctggtctccctggcttctcttcaaacgtaggaggtcccagtgaggtggtctggctctaaagatagctgccaacaatttcttcccatgtgccacgctgtcatccagaggagccccaagccgtcatgtaagaagctgaggttaggctgggcacagtggctcatgcctgtaatcccagcactttgggagaccgaggcaggtggatgacctacggtcaggagttctaaaccagcctggccaacatggtgaaaccccatctctactaaaaatagaaaaattagctgggcatggggcgggcgcctgtaatcccagctactcgggaggctgaggcaggagaattgcttgaacctcggaggcagaggttgcagtgagccgagatggtgccactgcattccagcctgggtgataagagtgaaac[131 bp omitted]cctgtctccactaaaaatacaaaaattagccaggtatggtggcgggcacctgtagtcccagctactctggaggctgaggcaggagaatcgcttgaacccgggaggtggagattgcagtgagcagagattgtgccactgcactctagcctgggtgacagagcaaggctccatctcaaaaaaaaaaaaaaaaaaaaagtcaaggctgttctgctggagagaggccatatggaagaggactgaagtgccagacatgtgagtgaagaagccatcttagatacccagcccagttgagccttcagatgactccagtcccagccaccatctaactacaactacctgagacccctagaagagccaccttactgagcccagtcaacccacagggccatgaaagagaagactgaattgtggttttaagccactaagtttttaggtgtttgctacacagcaatatacagccagaacacccagggaaggttgcagcagcccttttaaagcttttgacacccccatcccatatccccttcacaacacaatcaacactagcgagtcagactttcagcccctttaattaggtgctctgagaagaggtcagaatggcaggcagggggtggggaaggcggtgcttcttgagccccacttagcaactggtcactcatcctctggcagctggatcttgctggggtcgaagcagttggattccatgatgggaaggccattggcctctcggtatttcacaagcctctcagcttcgcggcgggaccactctttcatcctggtagtgcaaatagcaggggtagacgtgagggagcctcaactgataccaatccctcatctcagctccccattcccaatggtgcaggaacaaaactcctggcagaatccccttcaacctccatccctgcctctgcctcttacccatcccacgctcttggacaccctgtgcacctgtagtcaggcagataggccacaaaggtgctgccaaggaccaggatgatggagacgccaaagaagaagacaagtcgcatgttccagacgtccaaaacggggtccttgtcataaccatgggagtctgggttctgtggagaaatagaggtcaatgagggcttcctgctgctccacaaagccttattctggccctgcataacttggtctccatgtgcccctctcactaaattcctctgtttccattcttgggatatgtcaagctccttcccactgcagggccactgcacttgctgctctctctgcctggaaagcctttcttccagctctagtcatggctggatctgtctcctcattcaaggttttagattcatcaccacttccttcaggaggcactccctagttaccttgtctttcaaagttgaagcataggaaactgctatttttataggtcacaaatggttgaatactggcaatttcttatagctcaagctaatgaaatagccccctacacccaagtcattctctatccacttatcttgcttaactttgtcttcacatcctctcttccttctgtctctttctagtctatgtttacctaagtagcatactttccccattctctgtatatcatacattctcatgttatattatctattatactactttgtattattgttttctaatattttactgtttattttctgtcttccccactatcatgtaagctctatgagagcatgggctttgtctgatttccacactgctgtatccccagggccctgaactgagcctggcatacagcaggccctcaatacatatttacagaatgaacaagcatcctatatatccaagccccttaaccagaggttagtattgatgaagtacttattatgtgccagtcttttcacatagaaacacctcacaatatctcagtgaggtgaaacatggcaataataaacacattctagtgctgagtacatacttacgaagtgccagctgctgttctgaccatttttactcatttaattacatgaggcaggtggggtgtcctattttttagaaggtgtcctattactgttcccatcttacagacaaagaaactgaggcaccaagggtttatgctaccaagatcacacgggtgggtaaccgtcagtgctgcctgatttcacagcgtctgctattaatacagcacagcagacctggtagccctaaattcaaataccagttccacctccaccatgtattcagttatgtgagctagggcaatccacttaacatctctgtgcctcagtttcctcatctgtaggatgagtataataatagagcccacctcgaaatggggtttgtttcgagtataagatgagctaatgcatgtcaagtgtttagaacacagacggggcccggagcggtggctcatgcctgtaatcccagcaccttgggaggccgaggcgagaggatcgcttgagccaggagttcgagaccagcctgggcaacatagcgagatctcgtccctataaaaaaaaaaaaaagaatgcagacggcaacgagcaagtgccatatcggtgtttagtattatcgttgtactatactgcttctaacgtgttttgagcgctgtccacttgaggtgtgatttctgtctgcaaaataaaaccaatcctgcctctggccctggaacgaagataccgagagacaaaggaggaacacaaggtaggcaaaattcccaagtcttctaggctttcgccggccgcgcagtcctctactgcctaagaacgtcctctacagcgccccatctgccgatcccggactgaccccttcggggttccgtccccactacccccccccccccccccgcctctcaccttctcatacaagttttcgtcctcgggttctgggtcctcttgccacggtgtggtcggttctgggggccgctttcccgccacagcggacggggcgaccacagtcctggagaagctagattcccagcggacgcgggcggccgggagccctcgcgtcgccgctgccgccaaaagacggcgagcgctcaaaccaaacagcccagccgccatgacagatggtgctgcagggtctcaggggcggggaaagaaatgcgactgtgcgcagctgcagtgggtgcgagcgcgacaatcatcgccccgcctccgccacgctatataggtcccagatctgatttggttttccaatgaggcggggcgttgagcaaccctctttgcctccagttgtcgtggcttcgtggggccaaccattttcggccaggctgagaaatttcttattgatgggtctgctcatttcctgcataggaagaaatcggtgacatttgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaaggtgagcgtcgacgctggtcgtgggggcggaggtaaggggcccggggcggggacgtagaggaggcgcgagggcggacttcgggtcgggggagatgcgcggaacggaggggttggtgcaatgtctcaacccgggagggtttttttttttttggttttttttttttttttttttttttttggtgtgagcaaaggcgcgtgcgcgactgggacatgggatgggtgcatgcgggttgggggaagggagggacggatgggagtgggctactgtggatcactgtgtcggctacatcgaagtttatcagtggggaagcggttgtctgcgactttgagtttgtgcataggagaggggatgctgctctgtgttactctggtgtttatcggtccatggggaaatattctgtggttctggtctctattcctgggggatcggaggggggatgtgactctggtctttaccctttgagggggggcggtctgtgactctgatccttatccatggggcggggcttgggggacgactgtcttttgattgaccctaacccacttattgggtgggaaggggcatgcagggaatgtgtgtgtgactcattgccccttcttttggggagtttgtatctgtgacactgacgctcatccatggaaaggggacccactgtgtaattgtggtccttactgtgtgttccttctgtgatgtgggcccgtagttatttggggctcgtgtctgtgactggcccttggctgtggtggatgttactgtgtgactctggcccctttgccagagtctcttgaaggtttttgtgctctcagacgccagtgcctctgtgtgattctaactcttgcccacctgggagcaggtaactcgggttccctgtggcttgaggaggaagagaaaattggagtgtgtttgtctgtgtatgtgtgtgcacgagcatagagcaaaggtgtggcagcaacctagtgttgagcaggtgctattattgcctggctttacctgcttcttattcagagggtggggcctgaagatctgggattcatcctgacctctggctgggtcacagggttctcaggactccctgagttctcaccacagccctgagggttggatgaagtggctgctgctccatcccaatagaagagcacagtggttcagaacagcctccaaaagggccccttttgcctctggaaaccgggcttgagccctggggagggaaccaccttaggaccgggctgcacataagagacagggctcagggctgagccagttgctgtgtgagggccaaggctgtgttggccaggagcccagggaggtggcagctgtctcgtcgccaagttcgccccttcacacacccccccaagagcctttcatggtcttttgctgccttataggggacagccagcagcttgttgggaggatgagatggtcccttggggcctgtggaaggagcctggggcccccattgttgtgaagtcttgtctgatgtgctgaatctcaggcaagactttcagccctgagagtcccctacccccaccctgggatgcagccccaggcttgaatttgtctacctgtcttaggtggcaaagccctgatcacactgtgggtggccccgccaggtctctctgcaagatgccccctgtctgctgaagtccttgctgttttctagggcagtgggctctagccttatgtttgcggggaaagggaggagcaggccaagtaggggctaccttcatactgtgatgcacaggagtgctgggagctggaagacaatgtccctgggctaaggggcagcggagagccttgacaataagagtttctcaaggaggccctctcagtcccaacagttttgacccctttcttccctccactctccccagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacggtgagttatctgttctcagcttcccagacagcctaggcttgcgtctatgtgagaattgatccaagaaggtgctaggatggggcttctgggtagaggaaacagcatagcagatgatgggtttcttttcagcagacaggtgtttggcacctgttgtgagccaggacctgtgctaggctctgatagtgcagtgatgaatgagacatgagattgcatccttctcagtactcagggtgtcacagggacgctatgcagttaacgggtgggaggttgaggttggggctatagcctggggtatgagggatgggtgggaatggcaccatcagagtcaggatttgcccgggaccactaggggacaagccaggtcagatagtggaagactccagggacagtatgggctacagttggcatgatacttgctgggaatggatactctcagacagttatttcttcagctctgctatgaacaaggaatagctggaacactgggtaaaatacagaaatcctgagtaaaattcagtgatccctcgccatccaggtgattccgaggcaggtgacccagccatgacacttgaagattgcctagaaaagcagacctaactctctcagaaagcctctattaagactcaagagtcaatagctttataaaaagagaaaataatttttaaaatgttttacgaagtgtttcttctaccaccactccttttaaaaatgtagaattgtaatattttgttttctgaaaagtgagcccaaatttgagataaggtcatcacctagtgttattcagtcttggctttcattagaaatgttttttgaaagacatttgattttggacggtattcactagaagtgctctgtggccatttctgaatttgagtagctgacatacatactttgttcaaactttattaccaagtaaaaccattgacttttaaaagccctcaagtgcagaggtttgagttcatcatactttccagttcaaggtaggtttctgtcataggtcagcaaaaggcttcctcttgtcatgtttattttttcatttttattcccaattcccacctctgtgggcagctgctctgtcgtgtttgatatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatcatagatttatcatatagatcattttcatataaatgtatcatatagatacatgtatcatataaatacatacataaatgtatcatatagatacattttcatagaaaatgaaaatatgaagtgttgttttgagtgactgtgttttcagttgacacacatggcatggtgccacagtcttcgttttgtttcctgaactttgtattactcagagtgggaggttttttttgttttttgttttttgttttgagacagggtgtctctatgttgcccaggctggtctcaaactcctgggctcaggcaattctcctcccttggcctcccaaagtgctgggattaaaggcatgagccgctgtaactggccaacagtgctgtttttttttgtttgtttgttttgttttgttttgtttctttgttttgagaaagagtttcactcttgttgcccaggctggagtgcaatggcgcagtcttggctgaccacaacctctgcctcccggtttcaagcgattctcctgccttagcctcccacatagctgggatttcaggcatgtgccaccacgcctggctaattttgtatttttagtagagatggggtttctccatgctggtcaggctggtctcgaactctcgacttcaggtgatcctcccatcttggcctcccaaagtgctgggattatgggcatgagccaccacacccggcacagtgctgtatttttaacatctgtctgtattgccatgtatatgttactactttgtttctaattgctggcaagggcatcatggggcatgtctactgagttttacttaatacttcccccaagagtagatgcctgttgttaattttgatgtgctagcatcattttttttttttttttttttgagacggagtttcgctcttgttgcccaggctggagtacaatggcgcgatctcggctcaccacaacctccacctcccaggttcaagcaattctcctgcctcagcctcccaagtagctgggattacaggcatgcgccaccacgcccagctaattttttgtatttttagtagagatggggtttctccatgttggtcaggctggtctcgaactcctgacctcaggtgatccgcctgcctcggcctcccaaagtgttgggattacaggcgtgagccaccgtgcccagcccaacgtcaccttttttgctttatctgttaatgtatagtgttttttgtttgtttgtttgtttgttttgagatgagtctcgctctgtcacccatgctggagtgcagtggcacgatctcggctcactgcaaacttcgcctcccgggttcacaccattctcctgcctcagcctcccgagtagctggtgctacaggcgcccgccaccacacctggctaattttttgtatttttagtagagatggggtttcactgtgttagccaggatggtctcgatctcctgacctggtgatccacccgccttggcctcccaaaatgctaggattacaggtgtgagccactgcgcccagcctaatgtagtttttaccttttgcattcagatctttaatccatctagattccactcttgaatatggcatacggtaggctccggttttattttcttccatatagtaggcagtttttccagtaccacctcctaaatagtccattctttctttattgatctgtggtacctcatctgatttcaggttccctcatgtacatggatccgtcttgagtgatgtgatttgttccattggtctatttgcacattcttgtgccagcaccttactgtttttattattatggctttatagaatgtcttagtagctcctttgcacttatttttcaaagctggtttaatcatttatggggctttattatatatcaaaagttatcaaagtccctcaaaaacaacaagaattttgatcgatgttacactgaacttctctattaatttggggaaaattatctttgtaagtagtcatttcatctaagacctttgtagagaatattttgaaatttatgtaaagagcataaaaagctttcattttcataaatggaaatacaggtcttatgtattctttgttaaagtaatccctaggtacttcagtcactttcattatctttttttttttttctcgagacttggtcttgctctgtcacccaggctggagtgcagtggcgacctccacaggctcaagtgatcttcctacctcagccttccaagtagctaggactacaggcacgcaccaccacgcccagctaattttttgtagagacggagtttcaccatgttgtccaggctgatcttgaactcctgagctccagcaatccacccaccttggcctcccaaagttctgggattacaggccattatcttattttttaaaaaatatttttcatgctggtatttgctggggtagaggaaagctgttgatttctgtaagttacccctgctgtatgcccttattatttctaatacttcattgttgattctgatgttctttctaagtagttggtcatattgtatgcaaatctatcctgtcacttatttatttttcttcatttatagtattgtccaggacttttagtaccatattaaatagtataagtgatactgggtacacaaattaagatttactttggctggttgtggcagaaagtccaaaggataatggcttagacaagatagtttacttttctttcccataaaggcagtctgcagaagagcaattaatctagggctgacaggcagccccttctgtgtagccatcctcagcacatggcagttgagacagtaggaagaagggagaggaataaaagggaatgtgtctaaagtttctccattaagtatggtgcatgcagtaagtttttagaatgtatcctttaataaatcaagaaaattatctaatcttcgtttgctaagattgaccataaataagtattgaacttcaaaatcctgtgctttttttctccctttgtccattaatttcataaattgtggcctggcatggtggatcacagcaccttgggaggccaaggtggttggatcgcttgaggccaggagttcaagaccagcctggccaacatggtgaaacctcatttctactaaaaataaaaaaatcagccaggcgtggtgaagcatgtctgtaatcccagctactggggagactgagacatgagaatcgcttgaacctgggaggtggaggttgcaataagctgagatcgtgccactgcactccatcctgggcaacagagtgagactccatatcaaaaaaataaataaaaattttgtaaattgcattaaatgatatccttggcattcttgagctataccccacttgatcatggtatgtatgtatatgtttatgacttcttactttgaaaatatctcaaatttacagaaaggttgcaagaaaaagtataatgaattcccatatatcctctactcagaattacttgttttaagtattttgccacatttgctctatcactctatatctttttttttttttttttttttttttgagacggaatcactctgtcacccaggctggagtgcaatggcgtgatcttggctcactgcaacctccgcctcctgtgttcaagcaattctcctgcctcagccttccaagtagctgggattacacgcgcctgccagtacgcctggctaatttttgtatttttattagaaacgaggtttcaccatgttggtcaggttggtctcaaactcctgacctcaggtgatccacctgcctcagcttcccaaagtgctggaattacaggcgtgagctaccgcgcctggcccaccctatagctctatatctttacatagacacacacacacacacacacacacacacacacacacacacacgttttttttaatcgtttgagttggtggcagccatgacttttctttttgagtcagagtttcactcttgttgcccaggctggagtgcaatggtgcaatctcggcccactgcaacctcttcctcctgcattcaagcgattctcctgcctcagtctcccaagtagctgggattacaggcatgcgtcaccacacccagctaattttgtatttttagtagagacaggatttttc[131 bp omitted]acgtcttaagaacaaaggtgttctcttccataaccacaatatacttatcaatatcaggaaattaaacaattatatagtacttttattctatataaagcccatattcagatgttatcactcttctcaataatgtcctttataatggttttccccaatccaggatccagtccaagatcatgtattgcattgagctccttgtctcctttaatctgaaacagttattctatctttgtcttttatgaccttgtcatttttttttttcctgaacctatggattatattgaaagcatgttttaaagttagttgttttatagaatgtttctcagtttggatttttctgatgcttactcatgagtttttggcagaaatgttatttaagtgatttatgtatatttttaaaaccttgttagattttattagccattgtatcatctaggatatctacacctgtatttatcagtgaggtagtccaatatttttattttcagtatttatctggcattggaatcaaggtagcctcattacatgaattgggcagcctttgttattctctctttattggagaaacttgtataagaattatctgtacctcgaaaaacttggtaggactcacctttaaaagcatctggaggctgggcgcagtgggctgaggcagttggatcacttgaacccaggaattcgagacgatcctgggcaacatggcgaaactctgtctctacaaaaaatacaaaaattagctgggcgtggtggcaggtgcctatagttctaactactcaggaggctgaggcaggaggattacctgagtctgggaggttgagactgtggtaagccatgatcatgccactgcactccagcctcagtgacagagtgacaccctgtctcaaaaaataataaaataaaagcatctggagctggtttttgattaccatttcatctcttctgccaattttagcattttatattttctagaaatatactcattttgtgaagatcctcatatatgatgattcagtccagcatcctagaaatgctttataaaagggatatgcctttggaaggtgtttgttcagagtgctttggtggccaattaaaaatattcctttctatccaaatatgttcccttcctgagtttagatagcaagagttcaatacctgaatttatttggtttggatattggatgtcaagagagttcaggataatttcatctgaaaatttataaatttattcatatctgttcagttcttgattttttttccttttttttttgtttgtttgtttgtttgtttttgtttgtggagatagtctcactctgtcttccaggctggagttcagtggtgcgatcttggctcaccgcaacctctgctttccaggctcaggggattcttgtgcctcagcttcctgagtagcaaggattacaggcccgtgccaccacacccggctaatttttgtattttagtagagacggggtttcaccatgtttgccagactggtctcgaactccgtacctcaggtgatccactcgcttcagcctccgaaagtgctgggattacaggtgtgagccaccatgatggcccagttcttgaattttgatgactacagttcaaattgattgtatcaagaaccttataactactcataccactgacagt[148 bp omitted]catctctactaaaaatacaaaaaattagctgggtgtggtggcaggcacctgtaatcccagctactcgggaggctgaggaaggacaatcgcttgaacccaggaggtggaagttgcagtgagccaagatcacgccactgcactccagcccggaggacagtgcgagactccctctcaaaaaaaaaaaaaaaaaaaaaagagtttgggttccaagctgagttcgtggggacagggactttattttgttcacagcagtatccccattacctagaacagtacttatcgtatagccaatgttaggttaatatttgttgaatgaatgcatgaacaaataattgtttaaaaaaatggaagtcaaccaaaatgtttgaaaacatgtttaatggatatttgccccatttgttacttatctttatggtgttttccatagtttagtgtgaaatttcaagcatgtagcaaagtttaaagaattttacaatgggcctggtgcggtggctcatgcctgtaatcccagcactttgggaggctgaggtgggcagatcacgaggtcaggagatcaagaccatcctggctaacacagtgaaaccccatctctactaaaaatacaaaaaaattagccggctgtggtggcgggcgcctgtagtcccagctacttgggaggctgaggcaggagaatgtcatgaacccgggtggcggagcttgcagtgagccgagatcgccactgcactccagcctgggcaacagagcgagactccatctcaaaaaaaaaaaaaaaaaaagaattttacaatgaacaccatatatacccatccactagattctttttttttcttctttctttcttttttttttttttgagatggagttttgttcttgttgcctaggctggagtgcaatgacacaatctcagctcaccgcaacctctgcctcctgggttcaagtgattctcctgcctcagcctcccgagtagctaggattacaggcacgcgccaccacacctggctaattttgtatttttagtagagacggcgtttctccatgttgctcaggctggtctcaaactcccgacctcaggtgatctgcctgcctcggcctcccaaagtgctcggattataggtgtgagccaccgtgcccagcccactagattctactattaacgttttaccatacttgctttattacatatttacttctaagtttctcgtattttttacactctatagagatttataatttttacaaagccagatttattcattttccttttatgactgctgggatttgtcttgctgaggaaggccttccccactcttaaggtgatacatttttttcttatgttttctaatatttgttttctttttttaaaagttcaacttttattatagattaaaggatacacatacagtttttttttttaactcagtgaagatgtctgcacagcaggaatcatgtgggatgggatggccctttttcctaacgctggaccacttgatgttctcttccatcttcccccaaccctcatttagatcatgacatcagaaaatcaggttaaagttaagaaaaagaagaatcagatcattggggattcttagtagtagcatcgccattgggagctgctagcccagcgggtattccccatgccacccctctggatcttggctccatgggtactgggaggaggccttgttggccagggaggccacgctgtgctgctagaagctgggcgacatactggtggtgcagcagagtctcgggtgcggcagcttggaggtactacccacataggcattggccttccagggtgcatcctggcccatcatgctgctgcagcagctgtggctggtgctgcatgtctgcttgcctgctaggctgctcgccggcttggccaggagcttgctgtgcctcagtggggccacatcccctgtggctgctgtggctgtgctctggtcttggaaaatggtggcgatgtggttccagaggtctgtgaagaacctgctcacaccctcgtaggctgggaaggcgttgatgtcgatgacggcatgctgccccatctggttgttgatgatgatgtcggtgccgaacagcaatactcccagtgcctgccgcagggcccgggggagttcccggatgacctctttgctcggctgctcttgaacagaccagaccccttgatcttgtccagctccatcaggaccaatgatgactctggctttgacacactgtggctattgaggaagatggattcgtggtcacattgtgtccgcggagaatttcttgagcaagggcctctggaccacggtgtaggacttgctgaccacgaacaccttgtacagaacggtgttgtggttgatgaaattctagaccacacagggtggctgtatgccattcaggccctcctgattgaatacagtagacatctcgtgagagttggtgccgtgagccactctagttttgcacatgaacaggaaagccaggctgttcttctccagcagccacatggtgtcatccccgcacaggcttgtgacctccatgaagggcagcaagcagatcctgccgccttccatgtagatctcaatcttccagatgagtttgcaggacttggagcggtcgagcagggttctgacggcagggaaggagtccaggacgatggtttcagggtgggcatcgatgtagtcctgaaacctgtgcaccagctccagggactggctgtcattctggtcggcttcaaggatgacatcagtcaacttgtgaatgatgacgtccaggggtccctgctcctcgattggccggctgaggttcagctgcatgacttttttttttttttttttgagatcagtctcactcagtcgcccaggctgaagtgcagtggtgtgatctcagctcgttgcaacctctgccccccaggttcaagcgattctcctccctcagcctcccgagtagctaggattacaggcacttgccactacggctagtttttgtatttttagtaga[156 bp omitted]ctaaagccgggaaattgagcttcttgattttcttctcatgcagccagtagccaactctcttccctttcataaaggtctatatcttcctcctcgggcaaggagcctgggtcctgaggaaattgcccataggctgagtctgttggccagtgagcgctgggagcgtgcgggcaccccctggtggcaggggtgtggaaagggctcggggtgcggggttagggccgcgtggtgtcacggtctccacaacccccccacccctggccacccagctggagctcacggcccacatacaggttgttctttttttcatacgcagtttcactctgtcgcccaggctggagtacagtggtgcgatcggctcactgtaacctccgcctccctggttcaagcaattctcgtgcctcagcctgcccagtagctgggactgtaggtgtgcaccaccatgcccagctaattttggtattttttagtagagacgaggtttcaccatgttgcccaggctggtctcaaactcctgacctcagtgatctgcccccctcggcctcccaaagtgctaggattacaggcatgggccaccgcatctggcctgtacaggtttttttacatgggtaaattgcgtgacactgaagcttgaggccccgttgatcccatcacccaagcagtaagcttagttcccgacagatggtccttcagcccatgccccccttcccaccttcccggtctagtgatccccaatgtctgatattccaatatttacattcatgtacattcaacatttaactcccatttataagtgagaacatgcagtacttggttttctgttttcgtggcaggtggcttaggataacagcctccagctccatctatatggctgtgaaggacatgattttgtcttttttatggctgcatagtattccatggtgtatatgtaccacatttttctttatcctgtccactattgatgggcattcaggctgattccatgtccttgctattgtgaatagtgctgcagtggccaggcgccatggcccatgccagtaatcccatcactttgagaggccgaggtgggcagatcacctgaggtagggagttcgagaccagcctgaccaacatggagaaacgccatctctactaaaaataaaaaattagccaggcgtggtggcacgtgcctgtaatcacagctactcgggaggctgaggcaggagaatctcttgaaccaggaggtggaggttgcggtgagccgagattgcaccattgcactccagcctgggcaacaagagcgaaactccgtctcaaaaaaaaaaaaaaaaaaaagtgccgctttgaacatgggtgcatgtgatagaataaattattttcctttgggtatatacccggtagcaggattactgggtcgaatagccaaagcaatcctaagcaaaaagaacaaagccagaggcatcacattgtccaacttcaaactatactgtaaggctacagtaatcaaaatagcatggtcctggtgcaaaaacagacacataaaccagtggaacagagtagagaacacagaaataaacccgcacacatagaaccatctgatctttgacaaaatcaacaaaagtaagcaagggggaaaggactccctgttcaataagtgctgggataggtggctagccatattcagaagaatgaaaccggacccttacctctcaccatatacaaaaattaagat[133 bp omitted]gaaaccccatctctactaaaaatacagaattagccaggcgtggtggcgcatgcctataatcccagctacttgggaggctgaggcaggagaatcacttgaacctgagaggcggaggttgcagtgagccaagattgtgccattgcactccagcctgggcgacaagagtgaaactctgcctcaaaaaaaaagaaaaaaaatcctagaagaaaacctaggaaatgccctcctcgatacagggtttggcaaagaatttatggctaagtccccaaaagcaattgcaacaaaaccaaaaattgacaatttggacctaattaaacagcttctgcacagcaaaagaaactaccaacagagtaaatggacagcctacagaataggagaaaatcataagctacacatctgacaaaggtctaatatccagaatctacaaggaagttaaatcaataggcaaaaagcaaaatttccaattaaaaaatgggcaaaggacatgaacagatacttctcaaaagataacatacaagtggccaacaaacatgaaaaaatgctcatcatcactaatcatcagagaaatgcaaatcaaaaccacaaggagacaccgtctcatgccagtcagatggcaattattaaaaagtaaaaaaaaaaaaacatgttagtgaggctgcaaagaaaagaatgcttatatactgttggtgggaatgcaaactagtttggtcatgggagaaagcagtttcgagatttttttttggagagagagatttctttaatatttttatggtttctatttgggaatttaagttttcacccatccataatttatttggcgtaagaagtgaggtaaactttgttttcttagtgggcaacacttttctgtgaaggatcagatagtaaatatttttggcattgcattgcaggactgtctctgttgcaactaaactgaaagcagtcacggacaatttatgaatgaatgaatatagctgtgttccagtaaaactttatttaattaattttttttttgaaacaaggtcttgctgtgttgccctggctggctggagtgcagtggcgcgatcagagctcactgcagcctctgtctccctggctcaagggatcctcccacctcagcctcacacacagctaatttctttctttctttctttctttttttctttttccagtagagacgaggtctgactactgtgttacccaggctgggtctggaactcaagggttactcctgccttggccttccaaagtgttgggattacagatgtgagccactacatctggcctccactaaaactttatttaaggagactggatttggtccactggctatagtttgctgattcctaggccagatagttattgtaactattatttattgactaatttgttttccccttgttagtttgaaatataacctttggcttatactgaatttccaagtgtgtttttgtatgctgtagattctattctatttcactgatctgtctattcatgttttaattaatttacctttataatgttttaatatttgctagagttcctctcaactcattagttttttttttttttttttttagtgagagagagagagagagagagagagggtctggctttgtcgcccaggtgcagtggcgcgatcatggctcactgcatccttgacctcctggcctcaagtgattctcctgcctcagcctcccaagtagctggggatacaaacacgcaccaccacgcctaactactttttgtatttctttgtagagatgaggttttgccatgtcacccaggctggtcttgaactcccgggctcgagcgatccgcccacctcatcctcccaaagtgctgggattaggggcatgagccactgctcctggcttatcctttgttttttgtttttgtttgttttgagacagagtctcactctgttgccaggctgtagtgcagtggcgcaatctcggctcactgcaatctttgctccctgggttcatgagattctcctgcctc[134 bp omitted]gcctcccacagtgctgggattacaggcgtgagccactgcgcccagcctgtcctttgttttttaaaacaatgctacagtaacttttttgtacatgtgcaagtatgtgtatactttaaattcccagaagtagaactgtgggtcaaagggtatatagatttttagttttgtcagctattgccgaattctcctctataaggattattccatttttaactcctaccagcaatatgaaagtacctgttttccatacagtcttgctgtttgttttcaaacattggactgttgtaaatctgttagattaaaaatgttctatcaaatcttccttactagtgattattgtatagtacaatactatattatttaatagttatcataaataataattttaatataactccaaataatgtagatactccctcctctaggaggtagagcttaattaccctccttttgactgtgg[136 bp omitted]atgatgaaaccccgtctctactaaaaatgcaaaaattagctgggggtggtggcaggtgcctgtaatcccagctacttgggaggctgaggcaggagaatcgcttgaacccgggtggaggttgcaatgagctgagatggcgccaccgcactccagcctggcaacaaagcgagactccatctcaaaaaaaaaaaatagagtatggagagagaaatagagaaattttacagggaagaaacctggcagacagcaccttaactaggtgatcatggttaacatcaccagagataagtcatgttgttatcatgtactcttctgtgatatgatcagaagggcatttcactatctcacttctgttgtatgcttctccaaaaaaaaaaaaaaatccataatcttaggtctaatcatgagaacacatcaaacaaaaccagttaaagggcattctacaaaatacctggccagtgctcttcaaaactgttaaggtcattaaaaacaaacaaggacagactgataaaccttcacaggccagaggagactgagggaacatgacaactacatgtaatgtaatatttaggattaaatcttggatcagaaaaaggatattaacgagaaaattggtggaatcctaatataatctgtagtttagttaattccttagttttgacaaatgtgccttagttttgttaatattaggggaagctgggtgaagggtatacagggattctttgaacttttctgcaaatgtaaaattatttcaaaataagaagtttgacttcatcaaaattagaaacttttgtttatttttgttggttttatagcgatgagttttcggtatgttgcccaggctggtctcaaactcttgggttcatgtgatccgcccgtcttggcctcccaaagtgctggaattacaggtgtgagcccaccacgcctggccacaattagaaacttttggaagtctctctgaacctattctggttcagggactgctggtaacaacaacaaaagattagaaacttttttttttgagacgtagtctcactctgctgcccaggctggagtgcagtggcgcgatctcggctcactgcaagctccgcctcccaggttcacgccattgtcctgcctcagcctcccaaatagctgggactacaggcgcctgccaccacg[136 bp omitted]gcctcctgagtagctgggactgcaggcgcccgccaccacgcccggctaattttttgtattttttagtagagacggggtttcacc[133 bp omitted]agaaagtgaaaagacaacccacaatgggaaaacatatttgtaaataatatatctggtaagggattaacatccagaatatatgaactcttacaacaacaaaattatccaatttaaaaatgggcaaaggattcatgaccagcttgacttaacatggtgaaacccctgtctctactaaaaatacaaaacatcagccaggtgtggtggcaggcgcctgtaatcactgctactcgggaggctgaacctgggaggcagaggttgcagtgagctgagatcatgccactgccctccagcctgggtgacagagttgtactccatctcaaaaaaaaaaaaaaaaattggcaaaaggacttgaatagacatttctccaagaaagatatacaagtggccagtaagcacatgaaaagatgcaaaataacaagtgttggtgaggatgcggggaaattggaacccttgtgcaacactggtaggaatgtaaaatggtacagctgctgtggaaaacagtttggcggttccagaaaaagttaaacacaggattaccatatgatccagcaattccactcctagatatatacccaaaagaattgaaagcaataattcaaacagatacttggacaccaatattcatagcagcgttattcacaatgtccaaaataaccaaggggtggaaacaacccaagtgtgcacgaacagatgaatgaacaaaatatgcatactacaatagaagagtattattccaccataaaaaggaaggaaattctaacatactgccttgtggatgaaccttgaaaacatgccaggtgaaataagctagacacatagggacaaatatatgattccactactatgaagtacctagaataggcaaattcattgagacagaaagtagaatagaggctgtggggtggggtgagaattgtttaatgggtacaaaggttttgtttgggatgatgaaaaattcctggaaaaggtgatggttgcataacattgtcagtatacttaatgccactgaattagataattaagaatggttggctgggcgcggtggctcatacctgtaatcccagcactttgggaggccgagacgggcggatcacctgaggtagggagttcgagagcagcctgaccaacttggagaaaccctgtctctactaaaagtacaaaattagccgggagtggtggtgcatgtctgtaatcccagctactcgggaggctgaggcaggagaatcgcttgaacccgggaggcagaggttacagtgagccaagattgcgccattggactccagcctgggcaacaagagtgaaacttgtctcaaaagaaaaaaaaaaaaaaagaggctgggcgcggtggctcacacctgtaatcccagcactttgggaggctgaggcaggcggatcacctgaagtcagaagttcgagactggcctggccaacatggtgaaactccatctctactaaaaatacaaaaattagccaggcatggtggcacacacctgtagtcccagctactcgggaggttgaggcacaagaattgcttgaggcccggcccagtggctcacgcctgtaatcccagcattttgggagacca[132 bp omitted]gaggcaggagaatcgcttgaacccaggaggcggaggctgcagtgagccgagattgtgccactgcactccagcctgggtgacagagcgagactccatctcaaaatttaaaaaaaaaaggatggttaaatggtaaatgtatattttaccacaatacaaaatgatctagaaaaaatatacaaaaattaaaattttaagtttattttaggccatgtgcagtggctcccgtctgtaatctcagcactttgggaggctgaggcgacaggctcactttagtccaaaagttcaggatcaggctgggcaacatagtgaggtcctgtatctacaaaaaatttgaaaattagctggatgtggtggtgcattcctgtagtcccagctggttggggctgagatgggaagattgcttaagcccaggaggtggaggctacagtaagctatgattgcaccactgcactcagcctgggcaacagaccgagaccttgtctcaagtaaaataaaatttattttgaaacagtctatccaatgtagttttaattctcatctttctctctctcttttttttttttcttgagatggagtctcgctctgtcactcaggctggagcgcagtggtacaatcatagctcactgtaacctagaactcctaggctcaagcagtcctttcgcctcagcctcctgagtagctgggactatagatgtacaccaccatgcccaactaatatgttgtggtggtgatggtggttttgtaaagacgggatcttgctatgttgtccaggctggtcttggcctcgagcaatcctcccactttcaccccgcaaagtgctgggattacaggatgagccatctcacctagcaaaattttcttttttttttttttttgactgagtctcgctctgtcgcccaagctggagtgcagtggtgcgatctcggctcattgcaacctccgccttctgggttcaagcgattctcctgtctcgccctcccgagtagctgggactacaggtgcgtgtcaccacacccagctgattttttttatttttagtagagacggggtttcaccatgttagccaggatggtctctatctctggaccttgtgatccgcctacctcaccctcccaaagtgctgggattacaggtgtgagccaccgcgcccggcaaaattttcatctttcattatgagtgagatagagcatcttttcagatacacatcattgatatttttatctgtgaattctgtttacttcctttccccatattttttcctagtttattgtcttttgacttggttaatgatgttttttatttttctgtttttttctccaagcaaaagtattttatttttatgtagttgaatttagtaatcttttctgtggcttctggatttggattataggtttccccatttcaagattataaagaaattattcagttattctatattttcttttatgatttcatttcttttttttttttttttttaagacagagtcttactctgtcacccagactggcagtggctcaccgcagcctccgcctcccgggttcaagcgattctcctgcctcagcctcccaagtagctgagattacaggcgtatgccaccacacccagctaatttttgtatttttggtagagatggggtttcaccatgttggccaggctggtctcgaattcctgacctcaagtgatctgcccacctcggcctcccagggtgccacccacgcctggcctatggtttcatttcttatgtttaaatctttgatctatttcaaatatatcctggtatatatgtgaagtatagtcataatatcttgcacatgtctaggtatttaacctttttgatgaattgtacttgggacctttctattttctaaacagtggttacattaatttgtacccagcatccttactgatttattatttataacaagtttttcagttgattctcttaggctttgcaggtatactctcatatcatttacaaataatggtaattttaccttctcctttccagcttttaacctcttttcttccttccctgtttaattgctttagctagtgtctttagaataatgttaagaatgctgttgataacggacattctaatgttgttcccgaccagaattggaatcctgttagtatagtagcattcttctgtggcatctagttttttctattttaaataaacatatattggttgctcttagaatgcttttttagtcattatttgttcaaaataattgttgagcgcctactgagtgctagggaatatggcagtgagctaagggtcccctcatttcctggagcccatattctagtaattttttaactcaccaaagaaacacagattaggccatgcacagtggtggacgcctgtaatcccagcactttggaaggctgaggtgggtggatcacttaagcccaggaatttgagaccagcctggcaatgtggtgaaaccccatctctacaaaaaatacaaaaatgagctgggcgtggtggtgcgtgcctgtggtcccaactactcaggaggctgaggtgggaggatggcttgagcttgggaggttgaggctgcagtgagccctgataatgccactgccctccagcctgggcaacagtgccagatccattctcaaaaaaaaaagaaaagaaatgcagatgaaatcagctttgagatcattattttacagttattgcggtaggagaaattttaatgaaagagctgctagtgtcggcaaggtgacagtgaagcaggggcaggggacgtggtgcaagacagggaggaggagcctcacccccggggatcctgcaagccgaatgagaccttggtgagcattttggtatttgatcctgagactgagggggagccactaaagggagtgagatgggtttgagtggctttgccttagaaagcactcacatttgggatttgggatgtagagactgaactggggaggtccaggtagaagtgaggagaacagccaggccacaaccaaggtgccccatgagggaagccagtggcatggaccagagagtgacatagggatggagagaggcaggttgcacttcagagatgtggagcagggatttaggaatccctgtatgggggcgggcctgagggcttccaaagaatagagtagggggagggaaaaatagaaagtttacagggtgagaaacctggcagacactgccttaaccagatgaccatggttaacatcaccagagctaagtcatggtggtatcatgtacttctttctctgataggatcagaagggcacctcacttctgttgtatgctcctccaaaaaaaccaaaaccctacgagaacacatcacctgggcctcttgcaccttttagaaagggcaaccttctgatccctccccatccttcttcctccactagtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggtgaggagggggcgcgctgcgccaggcctggctgggatgggctcccaagggccctctgtgtctggctgcagcaccgtgtgcaggcagctctccactcccgtgccttcagactgtgctcggtggctttgcctcacctggagggcctgttcccactcccctctctgagggctcctctcccaacctgggtctccctggcttccacatgcttggctctgtacttctgagggcccctggccaccactctttccctttctccctgttgttcagttcgggcccatggctcactgtgaaccctgtactgcccgctcccagccaacttgggcacttgaagagcctcttccatgggacccggcgtctggggttgggaggacaacaaggggactgcagaccaccaagctgaggagctctgggaggccagccatgggcattcccagtggtgatagagcccctagacagaagggaaggacccttctggagaagccagtgccatgttgggtagttcaccctagcctgcgggatgaggcgcgatgtttacaccatcagggagcccccacccgaggggaagaaacaggcttgccttaggggaatcccagttggaggggcagtcagggacctggtccatgcgagcaggcagctctcctgtccagcaggctgggaagggagttcttgcaagcccagccctggggggcagtctgtgagctgcccactgccctctggagggtccagggcaaaaacccctttggtggactgccaggcttctccagtggcagctgtcaagctgtgcccagacgtctccaggagcactgggccctggccagggtgggaatggagcaccaagttatctggtgcttccccactgtgggcgggagggctttggccccaggcctgctctgcttagtcctggaatggatggattgggcaacagcccagagcccaacagccataccgttttgagcgtggtgtgtggtggaggactggccaaggctgaggatcagggactgaggagggagtgtctgcagccctcacaccacctccaccagctcctgctgcctggctctggctgagatctgaagctgttcttatgcccccagcttggttgcagggtggaaccgtaggagacatgcagccttcggtggtacagtgaagcaattgagcacaccccctgagctggccagagaggagaggaaaatcaagggtggggtctggtgtgctgaccccaggccatcttgccccaaggaggtttaagctgtgtcttgtcagctacctttgggagttccccccacaccaatactgtcacctacctctccccacccactgaaggcagcccccaaaaggaccccatggagaatttacagtcccagaaagattgcaggccggggcctgcccaccctgcctgcctgagcctttagccggagcccgcacatccctggctttcagagcctgcctgcctcacagagccagcggccagctcctaggcctgcccagactgactgcccgtctggtgtcactcatctcattctgtcggccaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacgtacgtgccccccatggccccgggcaggaggccaggctgggtctcctccagggccctcaacttctccccacccctccctcacctgcaacctcagcgcctttcatcccttctccccctccagctcctatcccccagcactgatccgtcctctgtgggcaggtcccatcggccccccggtctggagggaggagtgtcagagaggccggcttggccaagggacattggccatgggtgtctggtagtggtgggtatgggcgggagaagagcagtcctgcacattccactggtcatccagccattttgcatgtgtgcatcatgggccagacgctcaccgggccagtgctggctattgctggtagcagagatgacactggggccctgtaaccattgggggagggatgggattttctgaaatttccttctctttttcccccatccttttttgtcagcagcctggcctggcctcagagccttgggtggctgctaacagcctccacgcctgcctccctttcctcctgtttccttttcatacatacttctcatgacagccacactgaagccccacgaggcctaccagaataacctccaagaatagtgtcctgatcttggtccttcttagtctactccgccgcccctcaccccctacccccatgaattctctgatcagccctcctctgaaatctgctagctgctcattttgtaacagagaaaatcccacttgtgtatttgagggtttctaaggtctggcccacctgccctgttcagggtcagacagtagctggttgctgacatttgttgagaatgtatctcagggtgggccatgtgttaggtatgattcagtccccatggcagcccagcagggaaggtactctttgtattccatccttcggatgaggaaaccaagccctgagtgggaatgtgacttgccccaggtctcatagccagtgagtggcagagcagagctggagtctgaacccgggcagctggaccctagagcccactttttgctgcttcctcagccttccctgagtttggagtcctgataagctcttctgtgtgtttttccttttcaccctgtgtatgggtgtgtgtaaggctaatgtcctgtctgttgtttaacctggtggggaaactgaggcccagagacatgaagactccttcccaagaatggctggcataggctcctggtcctcagtgagagacctcactggcctagagaccctgcctcacctgggccaaatcctgaattgcctctgcagtttccctctggcctactccatctgggaagcaatccccaggactacatctttttgctttttgtctccaccctaagttattgctacagtcatggtctagggcacatggctgggatttgctcagactcctgtcctccccagtttgacatttatgtcatggatctcttttgacgcaagctgcaggtcagcagggcaggggcgggggtgcgggttatccccttgccaagggcaagaattgcatcccaggtttccttacttcgtggctgccagcgagccctttgtcagatcaccctgcccaccgttcttaagtggctggctcacttgctctcttgttctctgtgcccctgagggtcgtcctgctgccatgctttaccttgctctgtgcccatttcttcatttgattcactttctgcaagtctggggctgaaagtcaagactgtgaactggtgtgggcctggggctgttgtcactcagggaaaagctgcgaaagaggcggaggagactgtgtgcacatcaccgatgacccctcgggatccagaggcctccagccagcctcaggtacccagcggccccattgtgctgagcctgccctactctgtatctccccgtatagatccgtggccagctgcagtcgcacggcgtgcaagcacgggaggttcggctgatgcggaacaaatcttcaggtgagcttttgttctagtgccctccccttcaagtggccagcctcagcctccgaatctccctcctgcctctgccttctcccccactccctccaccaccttcctgccacagctgggaatgggcagcgtggggggtgccctctcttctctcccactccccacactctcctcacagctccagccaaaagcctcttcaatggggctgtcggggcaggggtgcagctctgagctgagctgggtgctccctggggtcagggccagggccaggctcccaggcacctcctctctgggactctgagtatctgagatggtaaccccctcccatacactcccttccctctcctttcttctccttcctctgcccctcactttcccccacattttttggtaacagcctctgaccagaaagtagctctgacgtggtggtcccacatgtgtgtcccaagggggaagcaggggatggctcttatccaaggacacatcccaaggaacagccaggacttcctggcctcgcctgttccctccctccctccctcttgcaggctgcttggagctggcctgaggttagcagggtggtggtggggggagttgtctctacaggacctctgcccaggctccccaaggcaggcacagtggggcctcactctgcctgggcttctctctccatctctcagtctctcctccccacacctccatctctctctctctctctctctctctctctctctctctctctctctttctccctctctctctttctctctctctgccccccccaactatattattcattccatcctcctatgcatcctaacggttattcttttgaacattaagcatgcccccccaagcccctctcatccaagccctccccatgtatctgcctctaaaggacatgctatcctgaggcctcaaccctgaatccctttcccaagcctggaatcttggttgcatgtaggtcttgctctgcatcaccccaactacaccacacacggacagcttctgggtctctctctccacaaggaggtgttccaggtgcggccttctcaatggccctgggcgcttctcccaggcacccattgattcttacctctaaggtcctcctggccaatcctggccaccattctccttttgtccaggggaacctggactgtttgtggctgtagtctccaccctgtggccctgaggtggctccctagcgaggcccgcctcccctgcgctgcggtgaggctgagatgaggtcgtgtctttaaccgcccctggtttccaatgggccaagagccttcctagcctcgcagagcagcctggcccagcttctcttttgctcctgtgattcaacacctgttacaggacccctcctgggcacccctggccttgagctgggcccgccctggagttacgtattgtggcttgtgtggagccagcagcctgcccaccatcccctccctccttctttggaggcagatctctcgtattctttccctcccagctgcttctctccgtctctgtcaccccaggctggctgggcaggtctgcccgagccccatctctctcttcccagttggtgtgtgtgtctctccccctaccgacctctggcctctgtttttctccctccaccttccctgccccacctggccatctaccttgccccccacgcccgctagtctttctctctctgattgcctctttctctttcttcctttttcctcttcccctttccctctctgccccccgtcctctcccctcgggtcccgcccccgggaacgccgtgtgtccaaagctgttgactaacccactgcgtctgtatctgaatgctgtctccaggtcagagccggggcttcgccttcgtcgagtttagtcacttgcaggacgctacacgatggatggaagccaatcaggttgctttgccgcacttgaacccccccccaaacaaatactactttgtaatcgagcgctccccatcgcctgattcttatggacacagttccctgccctgtggccctgtgtcccatccccccgccccctctctccccttcctgaccctcactatctcctcttcccatctctcgctaccccactgggcttctcatccagagcccacactcaccactggccccttcctaccaccaggcactagtgctgccccttcacctctcccagctgagcgttcagagaaagagctgccagggtgggttctttcacctagcttcccactcccccggggctggtggggggggcacccctctctggggttagccagagccaggacctcattccaccctcaggaccactggaagtcctgccagtgaggagcttagctattggcacagtcactagcaagactcattttgtcagccccatccctgcatgtgaatttggccctttgattttcatgcaaggggacagcactgctctgttgatctcaagttcccgtcgagtatgatagttttatcgacaccctggcctcacttcgccgcccctacccttcctatcacatctccacactcgcaggaggcaccacctcaggcagctctgtcttctcggcaaggacctgtgcacagtcagccctggggggagcctgtcccccaagcctggcacgggatcccaactcagcagctttgggacctccgagacccaaagatctgcctggtcacccacccctgcccagatccctggtgtagggcactggagagcagtttcaggggaggaaggggcagaggtggtagaatgggggatcccggcagaggcagccctggggccgtctcctcggggttggtaggctagtgccatgggcccaggacccagccatccatgggaagacggcctcatggcagaaacttccatctgttcgaaatggctctttctttttccccttctccagcactagcgcacctgcgctctctttctctttttctcccctctccctccccctccctgtctcccctcaccccccaagtgtagcctgtgtagtcctggccctgggtgtggcctggcagtgtcagggccgagtgggggtttctccccactgtccggcaagcgtcggtcagccgaacactgtgtgcctggtggtgtgtgttcacatgtgtgcgtgcgtgtgcccggcagagcagcaaacagctgcgcccgagagctgtggcgctttccctccctacctcccttcttccctccatccgctctccgacctccctccgttccctgtccctcatccatccagctgaagggctcgctcactctcttctcctatgctgaaacggtgcgtggggcactgctgcctggacctcactgtgctctgctttttcccgcagcactccctcaacatcctgggccagaaggtgtcgatgcactacagtgaccccaagcccaagatcaatgaggactggctgtgcaataaggtacaggggcggtgggcagcagttgtcatggacagagacagcaacagcagtggcggcgatctctcccttcctctcccgctctttctccctccatctctccccctcccccaatctctcctctccctctgtctctctctctctctctctctctctctctcattctctatcccttgctagctcagcttgagtagtcaccattcctagccagccatatacaaatgtgtagtgagcgttcacttggtgcaggctctgtcctcctaaaatgcagtcttgcctggagttccagtagactttaaggaaatatatacgtggatgatgaattagtgacagtgtagacttgaagtggtggtgtggagaatgtgggcttcagagccagactggctgaaatgagactatcccagatcggccttgattttggccaaggtgcttagcctctctttgcctcactttccccatctctaaaatgtgaatattaatgacacctctcccaaaaggtggttgggaggattcagctgtgttaatgagagagtaacactcagaacagtgcctggcccacatttaacacagtcgaattgttaactgtaatcatgaaagaaaagcacagagcgttctgagagcccatagcaggtagctcaagcctgaaggccactctgaccaggccaagtcaaacctgaaactggaggctgtggttttgtagtcacctctgtcttccctgaggggaagctgaggctcagagaggtggaaccatgggtgaacctttagctgtgccctgtgccttgctcctgatcacagggacttggatgccacagtggcttcaggtctgccctggggccagcattgtgattccacagtttgtagaggccccaaccctctccccaggaagtactctgcctagtcagggagagtggtgcatctgttttaaaaaaaaaagtcccatcagaggattggtgcttaacatttctggagagataaagacaaagtgacagtggaactccttcctgtgtttccagatagcctcaaaaccagggaattctcttttttttttttttgagacaggatctggctctgtcgcccaggctggagtgcagcaatctgggctcactgcaacctctgtctccagcgctcaagccatcagcctccagagtagctgggaccacaggcgcatgccaccacacccactaatttttgcctttttatttttattttttttggtagagacagggtttcgtcatg[137 bp omitted]catcctgttggccaccaggtcctgtcacttccatcacagaaacgccaccttccctccctcgccattcccgctgctcatgccaatcgtcacgctctcacccactcactgtggagccctctctggtatgctggcctcttgtcctctttctcccacgccctcacctggaacattcctcaaaaccacctctgactacccacgcctctcctcctctgcttaaccagccccagctcagcttaagcataagatcctccattacctaactggcttccttccccggccttggcttttgcttctccccttactctcccacaccagtttcggaaagtccattgttccctccgataacaatccctccccagcaaggcttaacaaaatgaaacttctgggcatcccaggtcaaacctccctgcttctgtgcagggactgtccctgccgagtaaatggcaccccacccccagcccatttccctccccgagcccctgctggatggtccatgcagaccgacctgcccctcttcatgctgcatctgcccctgtgctattaggccatgagggcagagaccatgttctggccatgtgcagcagggcctggcccaggagtggtgcttagtacctgagtctggaacagagatggagtgtggtagaagctgggtctccagatgctggaacattcaaggaaaatttctcaagcgtagcaggatccaacccagtcctagagctaagaggaggggtgcgggtctggctactgacttctagggctgaaacactgaaaggtttctgaatagaggagcaagtttcagggagaggaacctaataaagggattgaatacctgaggcggggaacagtcctgggagttggtggccttaagaaggcagaggaaggagaggagggagttgttgtaccaaatgggggagttgtttattcctgagctgagtgggttggcacagaggacaaatgagagtctggaaagggaagatgcacagtactgagaacaacatcagaaggttcagaaggcacctgccaccattgcctaggggctttccttcctggggcactgcggggtccctgggagatctcttcatccaagtttggagggtgcagtgggaaatccctgctccctctgacggcctggcctgtgcctcacagtgtggcgtccagaacttcaaacgccgagagaagtgcttcaaatgtggcgtgcccaagtcaggtgaggcccacctacctctcgtgctctccagggcggagcggttggggagaagggaagggtgaggggtctgtgctcagggcttggtatagggaggagggtgaccagtcgtggagccttccccttatcaccagcctgtctcccactgcccctgacagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacagtgagtcagttgttccttcttcctctgtgccctagggtgtcgggctgggctcaccaagaccagagaaatggcagtgagcaggacctcatcctcatggaatctccacttggtgcggggatagacatttgatgtagggagaacagggggagtggcaacatcccacctgactttgggggtgtgtcgggaaggttctcagcagacaggcagccaggctggcacctggaccgccaagcagagttgatcctggaggaagcagtgagggaagcggcagttgcaaaggcacggagtgagtgggggcagaggaaagggagcagtgggggcattgaagggcagggctggcaagagtgccaggggtgtcctctaacattgggccccttcccacagccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggtgagggcggcacagttgggggccgggcagccagggtcccggcccccggggtggagacgagggtccttttccccagcctcccaccgcggctgccagcctggaaatcgggcaatggagccgggggcctccccgggcctgacccttctgtccctgcctcccctcctcccacaggaggcagcccagctgctgcagatcctgcaggccctgcacccaccactcactatcgacggcaagaccatcaatgttgagtttgccaagggttctaagaggtcagggccccacctgtgtgccttcccacccttcccctccccaccctcccactcccccctaccgcttggggcctcctatctcactcccagtctctaacatcctcctcagggacatggcctccaatgaaggcagtcgcatcagtgctgcctctgtggccagcactgccattgctgcggcccagtgggccatctcacaggtactcagaccccttgtgcctcccagcgtcctgagacctgggctttctcaaccctcctgcaccctctctgaagcaggaaggctggcttgctatccatggatgcaaaaccctctcccagtagctggcatggctattctaccttgctcctggctctctagaccccctgggacattccccttcatcatcaccgcagctttcttcccaattgcctcccatgcgctcatgtacgacgccattgtgcctggcattctgtgctgtttggtggggtttttattgtcctgaataggtatgatatacacatatccttatatgtaatatatacatatatgatatacacgtatcatatgttcctgaataaaaataacgtataagtggttgagagaaaattgggagaagagaataaagaagtaagaagatggtgtcttccttggcctgacacccaacacacacgccacacacagcagaatcagcagaatcagccctggaacattttggcgttcatctgtttttctgtcttgtgtttgccactggcctatttgttctcttgtggccaggcaaccctcgctttccacttgtcttaaggctgcatgctttgtctgtcaggtagaaatactagccccacgtgtgggacagatgcttctagcaggttccccaccccccacccccacaccttcctgttctaatgaacccctcccacctgcccttcaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtgagccccagcatctctctctgcagctgtggtgggggccagcaggcataaagtccccggccccattattcacaggcattgtccctgccctgtccctccttacaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccaggtgagtgagccctgtgggtatgtatcccggggaggcaggcaggcggcaggggtggcatgggcagacactgagccctgttctcctgtctggccccatgaccagtcgtataccatcatgtcacccgctgtgctcaaatctgagctccagagccctacccatcctagttctgctctcccaccggctaccagccccactgcccaggaatcctacagccagtaccgtgagtagccacagcctgtgggtaggggtggggagttcttaataaagcagggaatagtgtgaccccgttcccctcaccccctagctgttcccgacgtctctacctaccagtacgatgagacctccggctactactatgacccccagaccggcctctactatgaccccaactcccaggtaatagggcagcccagggagggatgggatcgggtcaggtcgcgtcaggaacagctagccctgcaggttcccttcacaaggtcttccctcacatcccctcttccctcctcctccctcagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacaggtgaacaccagggtccagcagtcactggctggctgtgtggtgtcttccagcaacggcactctgtcagctcttgccctctcctgccaagggagatggcgggcaggtgtggatgtgggcagtgactgcttagcagaccatgctcttgccccagctctgctctttgctgaatggccttgagccagagcagtctcctcagtgtgtggcagggttgcccaactccaggaggtggcttgtgccatccgagtgagccctgtcaggtgtcttctgtcccatggtggggaccctcacattctgctggtgaatatacatgtatgccagagaaattctcacaggccataagggggtgggcaggaaaaaagccctgcaatgttttgtgggagtgggcagatggagggcacctcagtgtctctctgtggagaaagggtgtgacactgtgagcgtagcgtttacaagcaagcactaagtgttaccttagcaacctgatgaattctaaaaatggtgctgtgctggggggaacatggaaatatagaatgtggcattgtgtcatgcatataaagttatacacaaataaacattcctatgcatttttaaatgataaaatggaaatgcacaacaaatgtgacagcgtgggtgtatgtcaggggaagaggagtgtcttcatccatttgctgctccataacaataccacagactgggtaatttataaggaaaagagattgatttggctcacagttctgtaggcagggaagcccagtggtgttggcatctggtgagggccttcttgccgcatcataacatggcaaagggcaagagagcatgcatgagagcaagagaaaattgggccaaactccccctttttatctggaacccactcagtgatggcattaaatggagactcaaaaggtggaggggggccgggagccgtggctcatgcctgtaatcccagcagtttgggaggctggggtgggcagatcacctgaggtcaggagtttgagaccagcctggccaacatggcgaaaccccgtctctactaaaaatacaaaaattagccaggcgtggtggcaggcgcctgtaatcccggctactcaggaagctgaggcaggagaatcacttgaacccaggaggcggaggttgcagtgagctgagatcgtgccattgcactccagcctgggcaacaagaacgagactccttctcaaaatatatatatattatatatatataaaggtggaggagatgggagggggtgaaggatgaaaaattacttaatgggtatgatgtacattatttggctgatggatgctctaagaaccctgacttcagcactatacaatctgtgcatgtaacaaaagcacttgtttattttatttatttatttattatttttttgagatggagtttcgctcttatcatccaggctggagtgcagtggtgcaatctcggatcactgcagcctccacctcctgggttcaagcaattctcctccctcagcctcccgagtagctgggattacaggcatccgccaccatgcccagctaatttttttgtaattttagtagagacgggttttcgccatgttggccaggctggtctcaaactcctgacctcaggtgatgtgtctgtctcggcctcccaaagtgctgggattataggcatgagctaccgcgcctggctacaaaagcacttgttaccccataaacttatacaatttctttaaaaagcagccgcgatctcttgaggagggcagagcctttgtgacctaatcacctctgaaaggccctgcctgtcaacactgttgcatcagggattaaatttatcttttgagatggagtttcactcttgttgcctgggctggagtgcaatggtgcaatctcagcacactgcagcctccgcctcccgggttcaaggaattctcctgcctcagccttccaagtagctgggattacaggcatccaccaccacgcccagctaattttgtatttttttagtagagctggggtttcactgtgttagccaggctggtctcaaactcctgacctcaagtgatccacccgccttggcctcccaaagtgctgggattacaggtgtgagccactgcactcagccgggataaaggctccacctgtgaacactgttgcattagggattacatttctgacacatgaactttgagggacaaaaaacatagcagagaacacagccagagaggggcttggcaagaagcactggtgactggtgacagaaaataggaacttgcactactgtgtccctcaccttctgattgttctgcctcagcttccactcatctgcctcccagatgggcccgccactctgtccacactgcttctgccacctcaccattgcaaaccagtgggggtgggggcacagggtgtgttcagtgatgaggtcaggagtagccaggtgccaagtgccttgcaggctgtggttgcgagtttgggtttattcttggtgtgatgggaggcgaaggaagggttttaaggacattgtatttgggggtgggagtggcttatacttcatgaaagagcgctctgctgggaaaggtggtcaggagccgtagcccagaggccagatgaagccttctgcagtggttcggactagggatagtggctggcccgtgtttgaggatgcagggcagtgggtcagcagatagagttagtagccccagggtcatgagggttctgggaacctcacctccaccctcacccccagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaaggtgtgttggggccacccccctgcaccctgccccacaatcttgtccttcctttgggccctctgtggagtccctgaatttctgtgtccctccaccccagggagcactagccgagagacagcacaccagcatggatctcccgaaattggccagtgacgaccgcccagtgagtgcccaaggcagagaggggcgggggctctgatctggccaggcctgaccgcccaccctcaccctctacagagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaaggtaacagcggatggttggcagggcatgctggggcctggcccactgaggctcatcctcttcacttctcatcctgtccctcttgcagcaaaaccttgagattcaccggcgagcccacttgtcagaaaacgagctagaagcactagagaagaatgacatggaggtgaggtgtgacctgaccctgggctccctcccctgtgtcccttccaagtccccatcacctcaggcagctggagttcaatttctcacgtgttaaccccgtgagccttcttccccattttcctatcctggctgcttgtgcctgtgatggcctgaccctcaggacctgagcctcattagccagatggcatgccctgtgggaccccactccccatgcctgtgttgcctgagaaaagagaccagctccccaacattcacatacacatacaaactttcagcaaatgaagtaccgggaccgtgcagctgaacgcagagaaaagtatggcatccccgagccgccagagcccaagaggaggaagtacggcggcatatccacagcctctgtgtgagtggctgggccaggtgagggggtctggagcccggggccggggccggcaggccgaccactcatgctgtgcaccgcccctgcagagacttcgagcagcctactcgggacgggctgggcagtgacaacattggcagtcggatgctgcaggccatgggctggaaagagggcagcggcctgggccgcaagaagcagggcattgtaacgcctatcgaggtgagtctcaggcagtcctgtcccatcccccagcacccctcacagcatcccccaccagcctgacagagcctgcctccctcacacaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgcatgttggcctctcctctttctcgtgctctagcacagttgtatagcctatacagacacggggacccaagcagatggacaggggaccttatcaggccaaggtggatggcagtggtggcattcagtgtctggaacataatggctactagaacatggggttctgacctgtaccccgacccataatatcctggttatggcccctctcccttgttggttccagcaggttatgttgtaccaggaaatctagcaccaccaggcatgaagcgccccctgatcagagctaggactgggaacccccatcccctgtccttgctgccccctggctttacttagcctgcagtcccaaggctaaactgcattttgccatccctagatctggagacaatgccctcaggcatctccaagtagaatacaagaggtactcaggttccagttggcccagagccctcaacaggctgatgacagaggggtggaggtggagcttggcctgcaaatccaaggccaggtcccagggatgccctttgagaaccattcaggcctaccttctctgttgttaccacagtgccccacccctctagtcactgcaacccatgattcccaagtatgtgcttgtgctctcggcagaggttctgggtacagtggaccgtgacgctggggctgccctcttccaagcctcagagggccacagcgtgaaagggggatggtgctagaagaccagttggtgcaaagcccctcccccatttattaatatacattgtgacaccaccctgcaacagtcataggaggtggggttagaaggggacccctagaggtaggatggtgctgatctggggtggtgggtgttgcccaatgaaggaaggggatgggagaaaaaaagggtgaaggaaacaggattaaaaagaggcctcctgggcctgggcacagtgagttgcacctgtaagtaatcccagcaatttaggaggctgaggcaggcggatcacttgagctcaggagttcaagaccagcctggataacatagccaggccctgtctctacaaaaataaataaataaataaaattaggctgggcgcagtgattcgcgcctgtaatcccagcattctgggaggccgaggcagatggatcactggagctcaggagtttgaaaccagcctgggcaacaaggtgaaaccccgtctctacaaaaaaaaaagtacaaaaattagccagctgtagtggcacacacctgtaatcccagctactcaggaagctgtagtgggaggattgcttgagcccgggaggtggaggttgcagcgagccgagatcacgcccctgcacccaagtctgggggacaagagtgaaaccctttcttgaaaaaaagaggctgccctagtctcaggatgggtgtgtcttttagcagagacgcctccacattcccttccctcttcccaccccagagcactgctcccaaaatcccacaaggaaccctcaaagctcaactggcaggagtgcaaaatgatacagccactctggaaaactggctgcttcctataaagttaacatatgcttaacctatggcccagcaattctactcttagatatttagctccaaatacatgaaaacatgtcaacaaaagacttgcatacatatatttgtagcagctgtattcctaatagccaaaaactgggaacaacccaaatgtccaactagaggagaatggatacagtgtggtatattcaaaggatggactacagctcagcaatcaaaaggaacacaatgctgatacagatatcaaaggatgagtctcacatggtgagattgttcacatggtgaaagaagccagacacaaaaaacacataatgtttcattccatttatatgaagttctaaggcaggcagaacaattttatggtgatagtagaagagggttgaggtgaggagggtgtcactggaaagggttgcaaggtagctttctggaatcatgaaaagtttctatgtcttgattggggtgctggtcacatgggtgtatacctatttaaaagtccaacaagctgtataactaaaatctgagtgttttattgtatgtaaattatacaagaagttggaaaatcaccaccacagcaaacctcaataaataagaaggaaataatgaacagaaattgatgatatagagaacaaaaaatgacagattaatagaaaccaaaagcagaatctgaaaacaaaaattaagaggaaacacttttggcaagactggtcaattgaagaagatagaagatgcaaatgcaacagagcttttaaaaataaagaatgtatctgaaaatctagatgaaatgaatatattcctagagaaatatcaaatgccaaaactgttccatggagaaactgattactcaaatggagcaattagtaatatagaaattgaaatggttgtcaagatcttccctttccccacaaaaaaaaaaaaagggcccagatgatgtgtgtatgtgtgtgttcctttctttctttctttttttttttttagatggagtcttactctgtcacccaggctggagtgcagtggtgcgatctcagtttaccgcaacctccaccttctgggttcaagcaattctcttgcctcagcctcctgagtagctgggattacaggtgtgcaccaccacacccagggaatattttgtattcttagtagagatggggtttcgctatgttggccagctggtcttgaactcctgacctcaggtgatccaccctccttggcctcccaaagtgctgtgattacaggcatgagccacctcgcctggcccagatggtttttataagagcattctaccaaactcccaaggattcctttcttattaaagttaattcctttcttattaaagttgttctagatattagaaaaaagaaaagatgtctattttaacaggctagtgttagctgaagctgcgaaggaagaggcactctcatacatcgctggaggcaatgcaaaatagtacaaccctctcttccaccctccctctccctctcctttgtctattttcctgcctccacagggctcactgtgggaccacagatgcaccccactatgcccagctaattctttgattttttgtggagaccaggtggtggtggtggggtgtgtgtgtgtgtatgttggggcgtgggggggtctcactttgttgcccaggctggtcttgaactcctgggctcaagcaatcatcctgcctcagcctgccaaagtgatgggattataggcgtgagccgccgcgcccggccaagactccatttattaaaaggctaaagaattttgccaggcgcggcggctcgcgcctatagtcccagcactttgggaggccgagcgggcggtatcgcctgagctcaggagctctagtccagtctggctaacgtggcgaaatcccgtctccactatggtaacatgtaaacatagaaaagataacagtaaaattttttctgtgttataggaccgttgaccaaaatgttatgcagcacatgattgtatatccataatttatattactgtatatagtcacagatatctattataatacgggtttgtatgtgaaactataattttacttattgttatgtttatggtctgtgtatcttgctagaatgtcagctccatgagcccaaggaagaatttccagcacctggcccatgtcaaatgaacttttttggccacctgagtctcggtctccccatctgtaggatgggtgtgcctttccatgtggaggcacccacacgttccgtttcctcttcccaccctacagagcacggctccggcaattccacagctcaggcttacattttcccatattctggacgctggtgcccaccacgtgcaccaggcactggccagacagaactaccacccccagcatgccgcgcgcatttgggccgtaccacaacctgtagggtcatctgggtctgaaacgggcaccagcgacgcgggagcagggactgacgcccctctagcaaagcatctgtggtacatcccagacccggggctctccaaggccccgcgcttccgagctccgcgcaaactctggcttctcttgtacgacagaggtggtttgctcttccgttgccccgtggcttcagctcatctttggcaggaaggcgaggcttccgcccggcacagggggtgagctggagcaccgtgcccccaagcctctggacagcatttggaggagggtgcttccctaatcccaacttcggggaaacccctcatgggcgtatttggagcctccgggcccggggtgatatttagggggcgtctgcttttgagacccttaaggggtgccgtttggggacttcggggtgggatttgggagtctgtttcggggagcacccctcggaggcagggtttggggggctttggggagattcttagggtccgtgtatgggcacccttgtccgtggagcaggatttgggttattcttcaaggggagaagcaaagcttgaggttactaaagtcaaggcgggactgggggagggcttgtttcaggacggggtcctggtgacagaacaatcgggaccgacgtggcattgtggaggtgtcaggcctttgtgacctctggttttgtgatgaggtcctccccgcgcctggaggctcaggactgcgagactggacacgtcgggggcccagatgtttctagggagaggagcctcccagctcaggctagggaagggacaccggagcccagctcttcctgagctgacgaggcgccacccggcctttattcattattcataataaggtggggctgtggtaggcggcagtttttttgcctctttcgcacctggtccgctgaaggttctcggcttgtgaattattcacgaggggcggatcagcgtgccgaagggacgtgctgaaggggcgttctgaagtctgccgcgcaaacgagttcattgatgattcgcaaaagttaagtagcaccctgagttttcagtggcttttctaggggttccgtgcttaattcatgaggagcgtggcttttgcagctttgtctgcgtgatccgcggttagctttcccttgcaggtaccagagttaaaacctggcgtctagcaaagggatgaggcctcctacattgttcatttcttatggcctggtaatcccagataatcagccggctctggattcaaatcccatcgatcctttccagttgtgtgatctttggcaaatcgttttgtaagcctgaataatgggtatgaggataacgataagattagcttacactcgtttagctacttagcgcatttaatcttcacgacaatcctaggaggtaggtcattattacccccactttatagataaggaaactgggacacaggaaggctaagtaatttgcctaaggtcacacaatcagtgagtggctgggccgggattcaaattggggtctagttccgcaatctgtagtcttaaccagatgccataatgtctcccctccccattcccctgcgccgccatttgatagtactactactactaatataacacttagcatgtgccaggcactggtctaagccctttctacttatttcttcatttaaactccatcgcaaggtaagttgctgttattcctattttatggatggggaagcagtggcccaagttgggggtttctctagtggctgagtattcataactaattttatattaatgtaaatatatatttacatatcttaacatattacttttatattaatatataatattttaaaaatttaacagtgccttgtgccagcaatgttctaaggctcatcccataatttatattctctgattttcttttgtttgagacggagtttctctcttgtcgcccaagctggagtgcaatggcgcgatctcggctgactgcaacctctgcttcccgagttcaagcgattctcctgcctcagcctccccagtagctgggattacaggcgcccgccaacatgcccagctaatttttgtatttttagtagagacagggtttcaccatcttggccaggctggtctccaattcctgacctcaggtgatccacccgcctcggcctcctaaagtgctgggattacaggcgtcatctgattttcataataacacattactatcctcattttacagttgtggaaactgaggcacctgccaaagacatgtagtgagtttgggtttgattggaccaaggcagcccttgttcctgaggcggggagaatggagggaggcgtggagaggggaggtgggggcagggagtacacgtcccctgggttttctggtggcactgcagtgacatctttcattattcatgaacaggaaggcgtgctcactttgccttggctatagcatcgtaatccctatttgctgggcagggcagtcttgggtgtttcttcgccttatgcataattcataaattgggtggaacctttcttgacctctctgagtttccaggttgagctactgcagcagcataattcattattcaggacctgggagagtgtgttttccctgcagcagccccatttccctgcttacagtgtattagatgcagcaataggcgggcgtgccccttttattccaacccactgggcctcatgcattattcatgagtaagttgtggcctgggtctccttggcttccgggcccctgcaagatcatcattattcatgaatgggggtgtgtggcttccatgttttaacatctgctttctggttgctggttgttagtctaccaaccactcaacttcatgcataacttataatcaggaagcatggccttaacggtttttcttcgcttccttgacagcctggctgcaacaattcattcattagtcgcattccatgaggcgtggcctctgttttacctgttttcgttgttactgccacaatgtccaccaggtggtgctgttccacttctaaccgaatgaatcgcaaccgagtagggaactttatgcatgattcataagtaggcgcggcccgcttgcatccgggtttctgggggtggggcccaaggttttgttccggccccaggctcagcgtccgccatcttgtgtcggcggctcggctgtaaggaggtggcagggacaaccacaaccacaacggccgggggaggagaaggcggcagcggcgattctaggcggcccaggcggcggggaggaggagaaggaggagggtggcggccgggcttggcttcggctccttgaggagttggcggcggcgcgacccggggaaccggcattggtaaaaaaacgtcctttcactgcgcctcgccctgggcaggggtttcggggaggcactggagggccctgagccacgctgctgtcggggcgggccgcggtgactcgggagccaggaatcagcggagtagggagggggagcggatcctggggcggggccgactttccccggccaggaccactccggctccctctggttgcaaaatctgaccttggagtcggacccccaggatgtgcttttagagactcacgcccaacatctctagtctgggacctgactccgtcccgaaccttgtatctcagatcagaactcttccccagtctccaatagagatttacgtggatcagcattgctgatcagagctcctcaccattgaatgccgttaaagacctgccccagaatctcctttgagacacttcctagcttctcagtatttgtcctcaaggcttccaggacgggctagatctcgaaggggtccataggccctttatctctgtaagagagtcctctttagcattttccttcagacccccatcccacacacatgctagccgcgctcagagcttccaggggtactagaccctgtgaaaggccatttgggcctggcctttgtgtcgggggcccctcttcgccacacgtcaggtctcctaaccccaccctggccctagcatcttccatcagagactctgcccagtatttctactcagagacccctcttaccatctgccttgagagactcttcaattcctagactctgtcctttgacactttctctacttttatggaatttctcgctttttatacttccagtattcagagactactgagaggcctcagcatcttccccatcaggcaccttgaacccccagagccttccagtgcaccagataccagggaggaactgtttggatacataatcctccatcaaagagcccctgcgagcatctgctcttgcagatcccgttggcttctagccccttccatcagagactcgcctccccaaccccaccctagacccagcctctgccttcaaaaaccaacctgggttctagctgcttttttcacagatcccttatcctcacatcaggcctcagaatctgccctcagatcgtttcaaggtccctaacgtctgcagtcaggggttttcagcttctgctttcagcctccttggaccccaggatcattgtcagatgtcccttccccccacaggccttcttgttttctttttctttttcttttttccgagacagaattgtttcactatgtcgtccaggctggagtgcagtggcgccatctcagctcactgcaacctccacctcctgggttcaagcgattctcctgcctcagcctcccgagtagctgggattacaggcatgcaccaccacgcctggctaattttttgtatttttagtagagatggggtttcaccatattgcccaggctggtctcgaactcctgacctcaggtgatccacctgcctcggcctcccaaagtgctgggattgcaggcgtgagccaccgcgcctggccatggccctcttgttttctactgcagtagaaaaccctcttctcagcatctaccttcagcgcctccatggggtcctacataattggtcagagaaacccaaccccatttggggacctagccagtgtttgcttattaacctttttaaggcctgcactatctgggcccagcttcccgtttccacaccctcagagcagctgtgatacctagcatgtcctgtcagagattgacacagggcctttgtgttccattagaaacctctcccagcccctcaccatccaccctcacagcctcctgggactctgtagtaggaatgtcagatacacctctcctcttgcatgtccctatctattatttttggttaaagatttctctctgctaccagcatctgtctccagagtcctccagagcctcaacatcctcctgatggaggctgcctctccccccagaccccaacatcttcctgctgcctcctcagactctagaatcccccacccattccctttgcagcttccatggggcccagcaactgtcctcctacctccttgcagccttgggggcctccactgcaatttttcagcctttctccaaaagatccttttccagagatccgaatttgagtcttttcctaataccctagcctagtcctttccctcccaggacttctaacatctcctttcccatttgtctcagagcctccttgctcttagacacccacttcctgattctcctctcacgttcccatggacttctcagttaacccctcccagaaagcttgacatgctccagccccccttctctatgccctagcttctccatcctgctaacctgcctcctctcacacctccaagactcctccctcaaaccctctggtttgggaatagagaatgcttacgcttgaaaatcttcagtttggagactcaggtatgtttagaaactaagccacagctcagctttgccaaacagttcacagtgtgtatgttatggtgggggcctgagcaaatgttgaggtaggaagggtgtagattgtttttctgctgggggtgggggatctttagctcctctgcagagtttctgtcccagactcctgcttgccttgagacagggctgttccaaacctttgcagtcaaaatccacttgaacaatcatctgaaacttcttagactcttgctgcctgcactggggatccagaggtgaaatgtccagatattaaagtgctctctggccctggatcatctctaatttatggagtgaggaaatggcatgtcccaaacaaactgaccaatgacaaggcaaggagataactaagtaatagaggccactacacgtgcccagggaggaactcacatcctcaggtcagtgagttctgaccacagaccttggcttctttaaccctgccagcagccccttgaagacagtttcatttgtcccagcttttggagaaaatgaggctcagaggaaatgagatctctaccccaggtcagtcagagagtcagtaaatggaaaatatggttcacctttgtctctactaactcaccaagcctcttgctacccaggttggctcttagcattctaagcaattcacctggctatctcaggggctccagccagcctgctgcctcccctcatctcccattccttagccctgtggactgggccctgagcccaggggcatttggcaaacagtcccccaccagctgcatgcctctgggcgagtgaatggggttctctaagcctttcttttcccatttgtgatttgggcatagggttatctgggtcatggggattgttaagattagacaaagccctttcctctttgattgacacacagtatgctcttggtagatagtagggagctcttgtcattgtggttggtgctagtgacaagtgccaagatggaatcttaggtacattgggatacttagtgtcataaaagtctcagtgtgggaggacttgtgtgaacagaagactcagtgcctagaggagcacttggggtgaggggaagtgacgctgggtcctcccatctccagcatgtggacccagtcacccccaccaccagatttcacttccacagcaggctttattgttctgtctctgggacctagcaggtgaccctgggcaagttacttctcatttgtccggcaaggacactaaactctgccttgctgggtcagggtcatggaggggatgaaacgtgataacacgaggaagcagcctgggcttcagagtcagcagatcctggtctggtcccagctcagtgtgtgggaaccttggtcaccgaacgtccctgagtgaatttttttccatcactttaaagttgggggtattattgatagcagtccaaaccccacaggagtaccctgaggacagagtgagacgaggtttagagaagtgcttactatggcatctggcacaaggaggactcctgatcaatctaatactcatttatcattgtggttaacctgtttaagggactccgcatgcagatgaggcttgggatgtgtttgttttctatctttttgcaacctcttttattggtctgtgtcggttttcccctcccaaagctgggggcagggttgggctttataaaacttgagcccctctggggactgggttctcagcaagttaccgctcctgccatcatgccaccctgatggatgtccaagcctcacttccctcctgcactccccgctcccgccgccatccctgggattaagggagaggagaatggctgcttgttactgcctacctactctgtgccaggttctatgctctgtgttatttatcatctcgataaccccgtggggaaggtaagtggtattatcacccctgtttcacaggtgagaaaactgaggcctgtggcggttaattattactgttagtgcgtggcaggctcaagatttgaaaccaggtctgtcctgaatccacatccttcccctgacctcgacacaagtacattcttgtcattcctttcactccaggattggagtctctccctcattatgctgggctgggaagaagcaaatggcttagtggtcagcagtgtggatttgcaaatcagaccacctgggttcagatcttaggtctgacagctgtgttaccctgggcaagtcctcacctttctgtgcctgtcccctctttgctgtaaaatgggggtactaatacttaagtcttcccttcccccacagttgctactaacaaacagaaaaacggtacccatgtgctccagggtcacctctgacctttttttcctccagatgtccagctcgccgctgtccaagaaacgtcgcgtgtccgggcctgatccaaagccgggttctaactgctcccctgcccagtccgtgttgtccgaagtgccctcggtgccaaccaacgtgagtgtcctctccgtggagactggcagacgaggtggtgggtgggaaagtcttttgtatcactgtctgtctatccatgctccactcctgtgtgtctccctaaacttgttcttttcctctattcctagggaatggccaagaacggcagtgaagcagacatagacgagggcctttactcccggcagctgtaagtggggccaaggccgggctgaggggtgtggaatgggacattgagaggataaggttgggtggggcaggccctgacctagagtaccccctaacctggcaggtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccaggtacctcttcctagcacccttccccctttcccccttcccgaggcaccactgttcccggtgccacagccatttcatctttttccctactgcacacccttacagttctacctgcgggaggaggacatcggtaaaaaccgggccgaggtatcacagccccgcctcgctgagctcaacagctatgtgcctgtcactgcctacactggacccctcgttgaggacttccttagtggtttccaggtatcttgggggtactacccagccttctgcccagttttctcagagcccatctctggtttattcagtagtgttcaatattgatttaatgggtcggcctgaatgtcaggttttgtgctgggggactagagtatgcaggcagcagttagcccctggccctgccttttcttttcttctttttttttttttgagacggagtcttgctctgtcgcccaagctagagtgcagtggcgcgatctcggctcactgcaagctacacctcctgggttcacgccattctcctgcctca[135 bp omitted]ccgcctcccaaagtgctgggattacaggtgtgagccaccgcacccggcctggccccgccttttcaagtggggaagatgtgtacagacagtacagcatagtggttgtgggcacagactgtagagccatactgccttgctgcaggcctccagccttggtagtgtgacttcaagcaggttgtttcatctcctgtacctttgttttcctgtttgtagtcagtgcgtggtagcagcactgacttcatggactttttgtgagggttaaacacgtggaattgcagctggcatataaggactggatgggtgtttgttaattaaaaagtccaggccggaaagaggtgctctggaagctgagagttgtccctggagtatcccaggttgccagggcactgcagctaaatcctgatggaggagtaggagctcaccctggtggggaaggatggacattcaggcagagagcaaaatcccaaagatcatggcggagcaggcgtcgtcttgagaattggaagcaggtgggtgtggtaggagtgagctcagactttggctggagacagagttttactccagtgtctcacagggcatggcagacagacagcagcgggtgtttgtcaaataaatgagtcagctcttctccaaactccctcctcccagctacctcttcacctttcctggtatagtccaggggttcattttcgacccccacagagtctgatacacagtaggtgctatgtgtttgtgaaagaggctgacccagcaaagcctggatgtgtttgccttgaggactgcctgagtcctccacaccagccctccattttttccccttcaccccaatgctgggcctgagcctccatctctccacaggtggtggtgctcaccaacacccccctggaggaccagctgcgagtgggtgagttctgtcacaaccgtggcatcaagctggtggtggcagacacgcggggcctgtttgggtgagtggcagcccacctccctccctgtccccttttcccccaactcctaccaagcccaggccaagactctaggctctccctgccctcatcccttctcagctacccaggttttgggttctgtgttttcatctctccccatgtggcacaagtaccatcttacatcccagcagtgataggctgagtttgctcagcaagttttcactacatcttgagggacccgtgggacctgtatgtgcatgggacacaggcaccagccctattgcttccctctacaggcagctcttctgtgactttggagaggaaatgatcctcacagattccaatggggagcagccactcagtgctatggtttctatggttaccaaggtaaggagaccagccctagggttcctggcaggcaggtgggctgcagtagtccttcctgtctgctcttggtaccctgggcctgtttctgagactcactcttcctttaaccaggacaaccccggtgtggttacctgcctggatgaggcccgacacgggtttgagagcggggactttgtctccttttcagaagtacagggcatggttgaactcaacggaaatcagcccatggagatcaaagtcctgggtgagctgcgaccatgggggaagcagaggggaactagaagatatgttcctgggttctggccggggagttgaagggagaagacatggcccttggttcagagttgggaagacacatcctggtgtttgagatgaactacagacaatcctgtggggtccaataagagctggtgggcatgggggagaggtactgtgtttgagctattcctgggagaatgtgtccctggtatctgagctgagtggggaaaaagtctctggtgtttgaacagggcagatcagcggatctacttgtgtgtgagctgatttggatgggaagcagagaaggtcttcccgtgtagacttggagccagggacacagggtctcacggggtctgagctgagtctggggcacaggagagatggtttctgatgtccaagtggagcctggagctgagggaagacagcttctgatgtctgagctgagtcggggcaggaggttccttatcttgcaggggttgtggattttagggagaatgggtagactgacagctctcttcctgccctctgtaggtccttatacctttagcatctgtgacacctccaacttctccgactacatccgtggaggcatcgtcagtcaggtcaaagtacctaagaagattagctttgtgagtgtgtcgatgggatcagtgggctgtggggggtggttctaggcattccctagttctccattcctctcttctggttctgatgacctctccccccgccacagaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggtgggtgagtgggcgagccagccagcgcagacatgcctggcactgcaggctcaccatgcctctctgcgtgtccacactccctgccctcactgtggcctgacatatcctctcttggttctttctggcccaccaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggtcagcacgggtggggagaggcaggattggggtgggccaggttcctccatgactctgtcacttgctctctgtctgtgtcaggcccctgttaaccactgaccaccccctctctcccttcccctctccaggcctgctccgggaagttcatgcccatcatgcagtggctatactttgatgcccttgagtgtctccctgaggacaaagaggtcctcacagaggacaagtgcctccaggtatgtgggtgggacctgtggggagggcatcattggggacatttctggggaggcctctctaaccctcctccctttgcattccttagcgccagaaccgttatgacgggcaagtggctgtgtttggctcagacctgcaagagaagctgggcaagcagaagtatttcctggtaagtggtccccttggatgtctgctcccctcatcttggcctctggccatcacccctggggcttccttcggcatctcaatgcaaccggtggcgcattctctttgccattctccttatcttgaagggaagcccagtgcatccctcgtttccccttctggtgcctccttcctcacatgactgcgtgtcatttcttagagtcctgcaacctgaagatgtggtgttagcccctctccccgtctctcaggggagtgaggggtgatgggtagcttcacactaacctgcatcaccctgaccagcctctgcctgtcttcttggttgcttcttaggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacggtgagtagggtaggaggttggggctttgtcgtctcactttcctcctttttctttttttttttttttttgagacggagtttcgctcttgttgcccaggctgtagtgcagtggcgtgatctctggcccaccacaacctctgcctcctgggttcaagcgattctcctgcctcagcctcctgagtagctgggactacaggcatgcgccaccacgcccggctgattttgcattttaagtagagacagggtttctccatgttggtcaggctggtctcgaattcccgacctcaggtgatctgcctgcttcagcctcccaaagtgttggtattacaggcgtgagccaccacacctcacccctcctttttcttgttcccattctttctgtcagagatctttctgcctctgccagaagcccttctttttggcctttctttccctcagcttctgttttttttttttttttttttttttttttgccttaacctctttttagtgctggttgggacagtgtgtctggggtcctcaaaactactctcaagctcaattcacctagagtacttacaggactcagcatatagtcgtgcttgtggctacaatttattacagcaaaaggatacagaccaaaatcagcaaagggaaaaggctggtgcaagtttctaggagtcttctcccagcgggagttaaacaaggcggcctttatttccccagtagcaacagtaactacagaaataacagcaacaaggtgtaacaagacatgaaatgttgccaaccagggaagcttgttagactcagcaccacctcttttacttggggctggtcatgtaggcgcccccttcctggcacataacaaaatttccagactcccagaaggaaaggtgttcagcgtaaactgtattgtttgcatgaacggtttaggcacagtgaaccactgataccaggtagggagcggtgggaaccttcctgaattccaagttcccagacaccagccaaggagccgaccttggaagcaggcctttccaagggttgtagtttcagtctcctaggcttacacttctctgcacatatggaaactgggttggttatgcagggttctctgagaagctttctgtaaggagcagtgtcgtttttgcttacccaggatttattccccctttcatttatttcatttattcaccagatagttttagtactgttttaggtattggggatataccaaggaataaaacaagattcctggagggagaggggaacggacagcaaacaatagacacaatacgatcgtgaggtatatagttaatgttggtgatgagtgctcctcaaaggaaacaactaaaaccagacaagggaagtcggggtgtcagggagaatggtttgtagtattgatgacaatggttaaggaaggcctgagttctgcaaagacctcaaggatatgagggactagagtgccctctgctgtggaagagcctgcgcaaagatcctgaggtgggaggggtcagggagccaactcattttacggtaagtggaggtgggatccaggggaggattctgagcagaggagggacgtggcccaatttgggctttgaaaggatcctgcttgtctgtgtgccagcatcctggtggtggttgggggagtctgcatcaatcctgggtgctgttacctgaaaaaatagcaggtgttagacgaaagaacagatgtctggcccattgtctccagtctgttcctgtccacagcttccctttatgctgagcccctgccacatgcatcatcatcctggccatgtggcattgtcacagaccgtctctcctgctagcctcctaactcagggcctgggtcttcc[135 bp omitted]cagcatgacaaaaccctgtctctaccaaaaatacaaaaattagccacgcatggtggcacacacctgtggtcccagctactcgggaggctgaggtgggaggatcgctggagcctgggaagttgaggctgcagtgagccgtgatcatgccactgcattccagcctgtgtgatggagagagaccctgtctcaaaaaaaataaagatgtttgttgggtgaatgcacaaataagtgagctttgttcccccatccccaccctggaactgcactttcttaaccctttagaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgtgagtttggaggcgggtgaggtggtcacgggcaaagttgtgtgtgtttcggtgtgtatataccaagaggggtgtccgtctttctgtcctctcctgatgtttctttcctagctctcgctttgtgctccccacaggcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcaggtgataagctgtgggagaagggaaagaggccaggcatctggccaggctgctgcctctccgcccccaggcccttgccttgccttcagatgttgcatgcctaagtgtaagatgtgccttttctccaaacctccctccctcacttcccaccaggcagcctaggtttctagaatgactcattcttttttcacttttattttgatttttttttcaacacatagacaaatattaagaatattatgatgaatactcaaataccattcctcacctaaatttaacaattcttaatgttttgccacattttcttcttagatttatgtagatttttcttctttgtgcttaaatgtgtcacagacatcacagccctttactccctactatttcagtgcctctgccaagtgaggatatgttgctgtagaacagggtttcttagcttcagcactactgacatttggggctggttatttatttgtcatgggagaggggatgccctgtgcactgtaggatgtttctcagcattcctgacttctgcccactagatgccaatagcactctccctccatcatgacatctcaaaatgtctccagacattgccagatgtccccaggggtgccacatcactcccagttgagaactacttctgtctaacagaaacatcattttcatgctcagcaaaattaacaatcattcttaccatctcttctagttatttatttgtctctaatggtccatattcaggttttccccagctgttactcaaaatgagtttaacagctggtttgtcaggatgattctgtgtgtatggtgcatttatctacagaacagtgcatatattatctagctcggggtgtccaatcatttggcttccctgggccacattggaagaagaattgtctcgggccacacataaaatatactaatactaacgatagctgatgagctgaaaaaataaaagaaaaaaagatccgtgcataaatctcataatgtcttaagaaaatttacaaatttgtgttgggcagcattcaaagtcatcctgggctgcatatgggccacaggttagacaagcttgatctagctgaagttttacaaagtgaacacacaggtgaccaccacctgggccaagaaacagaacctagggattaccattgtgctgtcagaataattcttagtgcagtgtttgaggccaaaccatttagaatagtaggagtatgagggtgggaacaaaatagggaagggaaaaaaaaaacagttccatctgtcactttctcccttctgacactgcagttccagagtgggtatgtttgtatttgtgcaccaaccacagtcttgctaggtcatgtgtaaccttgaacttaacctctctgtgccgcagattcctgttctgtaaaatgggaatgacagcatctacctcacaggactattgtgaaccacttggcatttactgtgtgcctggcactgttttaaccaagctttaaatatatatgtatttgctcatttcttcctagcaaccccatgaaggtaggtatcactgttgtaacacctgttttagagacaaggcacagaggtaaagatgttatcctgtgtgcctgaagtcacaaaactaggtaatacgtggcatagctggaatctgaacctgaatttctaacatctgtacactccaaaccacctcgctaatgactgcgaactgtcctaggaattctcagaggccagaagttctgtcttgtttgctattttattttttgagacaggtctcattctgccattcaggctgaagtgtattggcacaatcatagctcactgcaaccttccaactcctgggaagtgtctgtacgtgtgtgtgtgtgtgtgtgtaagtgtctgtgtgtacgtgtaagtgtgtgtacgtgtgtgtgtgtgtgtgtgcgcacgcacgcgtgcccgttacgttgaccaggctggttgtaaactcctgggctcaagtgatccacctgcctcagcctccaaaagtgctgggattacatgtgtaagcctctgtgtccggcctctgtcttgttttctgccaagtcctcagggcctggatagggatcattgttggtttggtctgagttttttgtgttttaaaaaactgtggtaagatatacctaattgaagtttttattttttatggaggcataacatatctagaataaggtacacagatttttttttttttttttttgaggtggagttttgctcatgttgcccaggttggagtgcagtggcgcagtctcggctcactgcagcctccgcctcccaggttcaagcgattctcctgcctcagccttccaaagtgctgggaatacaggcgtgagccacctcgcctggcactcagatcttaatacatttttaggctgggcatggcggctgacacctataatctcagcactcaggaggccaaggagtgaggtttgtttgagcccaggagttcaagaccagcctaggcaacatagcaagaccctgtctctacaacaaatcttaaaaattagccgggtgtggtggcatgtgcctgctgtcccagctattcgggaggctgaggtgggaggatcgtttcaacctgggaggtcaaggctgctgtgagccgtgattgcatcgctgcactccagctcgggtgacagtgtgagactttgtctcaaacaacaaaacaaaacagttttccacatacacagcactattgtaaccactgcccaaatcaacttcattgatttttctttttttgagacagtcttcctctgtcacccaggctggagtgcaatggcatgatctcggctcactgcaacctccgcctcccgggttcaagagatttcctgcctcagcctcctgagtagctgggattacaggcatctgccaccacgcccagctactttttgtatttttagtagagatggggtttcaccatgttggtcaggctggtctcgaacccttgacctcaggtgatccatctgccttagcctcccaaagtgctgggattacaggtgtgagctactgtgcctggcctggtttttcaattgaggtgggggaatggggaaggctagagggcttccccacttccagagtagctgtgcgccttgtacttgctttattcactgatggtccttctaataatgcctgcggaaacccattttgtcaactgtggccacatgtaatctgtttgctctgtctgcagtgggctcgggatgagtttgaaggcctcttcaagcagccagcagaaaatgtcaaccagtacctcacgtgagtaactcgagtgccctctcgccctgtccctgtccaccagccaaggcatcccggctgctttcctcatgacagtaacacttggcaccaggcacacttttcacatgaatgagtggctgttggggcctcatgttgtttggggtcgggactagttttccatggagaaagtaagattgctctggagcccactcttgaggctgacatgtaatcctatcctctgtcctcttcgattcctgatagagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccaggtaatgcccagttgttgggtccatttggcagaatgtgtttccctgaaatgggagcctgcagtgtgggtcctcccactgtggagtccagctgtggcaggtgccctgaggcatggggatctgagaagagtgattgatcctgacctgctttttcctcaccctagttcctttgagcaaagaggcttggttgctattgcccttgactgtggtgtgggctgcgtcatacctgattcccagtcagggctgtagggattatgggggagaaattctggagttaagagcacaggaatcaatatgggttcaaatccaaactctacttgaacttaggcaaatcacgtaacttctctctgtacctcagtttcctcgtctgtgaagtagaaataatagtgatctatctcatggggggtttggggaggattaactggtatttattaaaatgaagttagtacaatgcctggtaatccatgagagtttgttaaatgatgggctgtttagcacaaaatggctacccagtgattggtaattgttctctcagccagatctctggttcaacctgtgggaccctacagttgaggtattttgtgattggctccagtccgcatcgagtgcccaacccaagatagtgaattgggggcacatctggggcctaggtgaagcgtgaagattgtcagagaggccttcactctcaggtcctgttctcaaaaatctctccatcccttagctcacaagctcaggagcgccgttctggtctgggcccaaacgctgtccacacccgctcacctttgatgtcaacaatgtaagtctcctttctagggtcttctggggtcaggtggagggtgaataggtgggaaggaggtggcggctccccactcgagggctgatgtgctcacccttccctgccctgccttctcctagcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttggtgagggtgtttggccagttggccaggagtcaccccacatgtccccggcctagtccagcctccccaccagtcctctacccctggttctgctctgctctgtgaccccaggcctgaggtttacccacaccttcctttgagcctccctttgacatgaagagggtaggttggggcaaattatctccctccctcctcctccttcccactatctggccctcaggagaacttgctgttttactcttgctctgtgtatttcccttagttttgttctttcttctgtttcttcttgatctgttcatctaggaggtatgatctctaccagcagtctctctcccttgatactttcctgccttgtctccttccagatccgcccccatctgtacatctacctgcatgtttctctgtgcatcttcaccctccatagtttggggctgcggtttactgacacccccaccccaccccatctgcatattttttcaccacccctcccttctgtatatgatgcttctgtagctctgtaacgccccctacatttaccttccttatatctcccccgtcttcctctccatagatctcctcccatttccccttccatggtccccatcttccttctgaaatgtctactccttcatgttcctttatgtatgtcttccaatctttccttccatagctctcatcaccttcatatatttcttccatctttctcctcccacctgcctcgccctctgtatatacccccactctcccccttttatatcttctccatctccccccatatctttcctctatgtccacatctgtgtattccccccaacttcccctccatatatcttttttactccccttttcctccctgtatcctctgtgttccccccatcttgctctacatcattcttcccaagatctttacgtctcccatcttgatctctccatctccactttctcctaacattttcatttccgttccttagtgtctctagagagatcattcttgatagcctcagctctttctctgtgtttttcaggtttgtattctgctctgctctacctctcctccttgccccttttctctcccaggatgtctctcctttccaaatcctttttgtacctgaataccttttgccccaccctgggctctcatttccatctcagaccttagcctgggatctaaagggctgacagtgtccctttcttcatgcagatgacagtcgtctagaggagctcaaagccactctgcccagcccagacaagctccctggattcaagatgtaccccattgactttgagaaggtatggggtggggctcaggacagggaaggaggatgggcaaagcatagacaggctggagaaaacaggagtatctggagccagccccgggcctttgtggggatcagattgtgggcctgccatatggctctgaatgagtaggtgttcccagccatccctttgtgatctgggagagtccagcaggcaattgcagtggaggatacacatcttctttatctgatcctctccccactgccttcacaccctccccactcataacaggatgatgacagcaactttcatatggatttcatcgtggctgcatccaacctccgggcagaaaactatgacattccttctgcagaccggcacaaggtgaggggaatctaaatctgatgttccaccctcctccaggtttgagttacccacacttagcccctctgtagaccctgaggctcttgtacttaactaccaccttcttttgtcccttctgtctctcagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccaggtgggggcctgcatccgaagcagggtttgggtggggtgtatctgtgtagatctggttctgattcacgtcataccctgtcaccaggtgagggtttctgtctgtgtacctaccctttttgtgtatcctttttcacttattcattaatcacattatttgagtacgtgcgaaaagatgggatatttgaattgtgccctgggagattattagtaactacacaataatggcagccaaaatttattggacgcttcctacacttaagtgctttgcttgcttcattaatgaattcactcaaatatttattgagcaccttttgtgtgcagggactcttctaagttatgttcctcaagtagattatataaataacctatta[135 bp omitted]gaaaccctgtctctactaaaaatacaaaaaattagccaggcgtagtggtaggcacctgtaatcccagctactcgggaggctgaggcaagagaatcacttgaacccgggaggcggaggttgcagtgagccaagatggcgccattgcactcccgcctgggtgacagagcgagactgcatctcaaaaaaaaaaaaagataaagaggacttgagaataccagggggcgaggggatgtatttgagattttgtgtaggatggtcagaaaaggccttgctgaaaagatgacatttgagatcagacttggaggatgtaaggggacaaactgtgcaggcttggtggcgagtggggacacattccaggcagagggaccagttcttgaaagggtaccaagataggggtgtgcctggcaagttggaggaattcaaagtccccagagtgagtgtgagattgaggagggtaggagatgagaagaaaacagaatttcattgcttagggtgagataggaaccacaagaggatttcgaacaaaagagggttgtgatctgactaaacacgtctgcatgggggtaggggggatggagacagatgggggctggaccctctgggatggtctccatcttacactcccctctttgtcttgcagtactataaccaagagtggacattgtgggatcgctttgaggtacaagggctgcagcctaatggtgaggagatgaccctcaaacagttcctcgactattttaaggtaaggcccctcccttactctgtcaccccacctcagggggcgaggtgtacacggtgacttgctggcctgtccacctccatgaccctgctgttccccctccctctccagacagagcacaaattagagatcaccatgctgtcccagggcgtgtccatgctctattccttcttcatgccagctgccaagctcaaggaacggttggatcagccgtgagttggacactggccaggctaggggaggccctgtatgggttggggagcctcatcatccagctgtcccactccagttcactgcccctacctacctgcccatcctctcttgctttctgccctcctgaccctatactcccatccccctatccccaggatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagctgtctggttcagatgataactcagagggctcaaccccaccacacctgccagttttctggacaaagaaaatgtaattgccacctcttcctgccctctctgcctaggaagagatggaggcaccagtgaggccatagtgagcaggtacttgggtccatgtgactgttaatttgagctgggttcaattctcaccttctccatgtcctaactccttgctctgtgaagaggaaagttacggtgaccaggctgctagggcatggccagcgtgccttatgtccttagggcagatcccctcccacctggctcaaagcactcagaccctgggcagccttttgtggtcatggttcccagcaccaggaatgcctgtgctgctcttagttcaatttccttgctgcaggggtgtcttaaacagctctgccgaatgccagtgcctgcaggcatacttcgtgatttttatggaaatacttgagaacatctgtagaggaaaagcccgttgcttgccttacgcttcccccggccctgccgccgccccagccccaggtctgcctgtattccccttgaggatcttcagcctcctactttggagaagacagctggctgtggggactgaggggtgttcatcgcttagagcaggtagcaggaggcctaacaccagccccaccgggactgcagagttaccgtgctctgtccttggtcttggctgagtgctccagacaattgaaagcaccagtctggccactgctacatctttgccttcttctattgtactggctcctggtgcctgaggagtccattcatacttctgttcctcaactaaccaataatttatctaccttacttagaaacaagatccctcactcttctactcaaacctgagtgtaaggaatagctcaacctgttctgaactggcttgattcccatcacagcctgtgcccacatctgctgcctcctgggccagtagttcctggtcctgggcacagtatatgcccttgtccacctccttctgatcattttattttcttggcctgctctgcttgggtgaccttatccttccacagtttcttcttccccactaggacgttgaggacagaggcattttccctttggtatctagtggtgatactgtcaaagggaaagtttttcccaccacaggaactttcccattattgctctagagtaccctagacactccacaccgcagtccactggccacaccactacagcagctgaggcttgaacacaactgttgtcttctttctccagtatgccagctcctttgcggatactctatagacaccttgttcactgcacctcccccattacggctccatgtcttccccaccacaactcctggatctccttgacaccttattcgtgcctgacacccttctccatcaaaacaagcttttgagtcatgcatgaatcctggttgcatcttagttgttccccctccacctcattccattttacttctgcggtttgtctaccagtctaccattgttaacaccagccagatgggagatcagggcttagcaggcgggggttgcgtcattgcaccgagccccctgcacccagcagccacaaaggatagggtgggacaaaggtttctcttgtcactgcctggaactatttgcccacctccttctgatcattttattttcttggcctgctctggcaggcattcaacaaacatttgttgtgtgctgtgtgccagtcactttctaggcacgtgagacagcagtggataaaacaaagatccctgtcctcttggggttttacgttctgctaggttgacacccagaatagattataaacacagtaagcaaattgtaccttagaagttgatcagtgctcttcaaaaggcgaggaatagagcccgatctggggatctggaatgatggcagtgcaggtaggaatttttaaatcggaaaggcttcatggagatgactttgaagcaagcacctggaagaagtgagagaatgaggcacgtggatgtgggccagcagcattccaggcaaagggaaccacagcaaatgcaaaacccctgaggctggattgtgcccgtttcactcaaacagctagaaagagcgctagtatggtggcagtgagtcaggggaagaagaggaagagatgaggtcagagaagtgatgagcctgttctatgccaaggcgaggacttttatctttgtcaaatatttccactcccatcatggcccgggaaatctcactaatgtaaaccttactgaaaatcctaactgctgtgatcaaggctgccataaagggaagcccggaagaggcggggaggctgccttggaacagggtagtgtaaggatgtgccagaaggcctgctggaggttgcagccctttgagctggacttggggatagtgtggttttccaggcagaaggaagtgaaggattaggtcggcctggtagtacttggcacacaacatgcgcccaataaataaaatggaaataaaaccgcggagtgttctacttgtgttgactgacatcaaaacaaaacaaaaaaccctcagagtgaggggaggcacgggaggggctgtgccgggcaagagaggtggcaggaaaatccaacgcacggcgcctatgcaaatactcgtgtgaggcagaaaagaggctccgccccgctcgaagttccaagcatgcgcagtagcggctcctgcgcctctaaggatccgcctctttccttctttctcagcctgggttccaccccgggaggcccgctgtatgagatggagggcgggctaaaggcgggacgagactcgattgagcgcaattatgaccaatcaccttgcggaatattcggcctatagcgaaggaggagctcagaacaaaaaggagaccccacccccgccgacggtgaaaacctatgaaacctgggcggaggcgtgcggagtcgggtagagagcgaaatcacgcctcttcagtcagccacgccctttattcttgctcggcctcgccacagagagcaaatcagattggctgggcgacaacctcaaagggcggggctgcacacgttcactacgggaatgaggtagcggtggagggggcagttgggcggggataggccgtcctagctaaggtggtaaaggccaataactcttcaggctgcctctcctcgaaaagtcatcttctcgcgaacctttaaaatgccttcctccccaagcacctcaagggactagaactgagtgcttcatttgtcttttttcctccttgcaaaagtcccgtttgccaccatggggatgtaccaagtgagaccgagtagggggaacgagtggtgattgacgcgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccgctgcggacgggtcctttggtacatgcagtccgaggtgagtcccctcctttccacttcacccttccgagcgcctgcgtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccggtgagcgcgtccccgaggcgtggaggctgcccctcctccttcagaacccacctcgggcggtgcccaggggtctgggctgcggggctggcaggtgcccccacccccggcgaatttcccagaatgcaccggggcggggggtcatttggggcctccctgaccttggccccgccctgggcctgtcctgggagctggggttgggtagtgctgtgggtgctaatggggacctgggggagtcaaaggaccaaagggtgtggaaatgggtgacaatggggtgaaagacttgggggggttgctgatgggggtcggagcatgtggcagtaagcctcacgccaataagtcgtgtaaggttcaaggccccgtgtgtgcttgtggaaggagggcggggtgcggagcgggtgagggacccgagggtgtataacggggggtagggtgtcgaggaagttctaagacatgctcatagggattatgtccgcagagaggcccggtgtgtgttcatgggggacagggtggcacaggtaccagaacgtgtgttggtggggtcagggctctgaggcctggtgcgtggcgatgaggccctggatggtgttaatactgcgtgtctgtccgtggggcctgcagtgtgtgagaatgcagtgtgtgcttgtggagggcaggtagctgaaggactcgagtgtggtgtgtgcgccagtgggggtcatggctgtagagggtgtatgcctgtggcctcgaaggtctaggtagtttgggacccagtatatgctaatgagggcagagtggaggaaggacctgagggtatctaacggaggaaggactgtggaatacctgagcctggcctaaaggagatgagaattgcgtgtctgtctgggcccaggaaggagtggtggggaagtgtcttagcactgtcagaggcttagtggacgaagggtaaaggtgatgtgaggtgtgagtgtgtccatggacacagggaatgtgagtctcgagggcacactaggaaggagcagggtaatagaagtactggtggttgctaatgtgggtttagagacatagaggcacttcaatgtgtgccatttcgagagtcagctgtgtgaagtctggaatatgctaataagcatcagaaccttgtgaagattgtgcccttgtgtccgcggaggaccagagtatgttgaggttccagggggtgctactcgggggtagggctgcggaggggatctagtgtgtaataagggggatcagggctttcatgaagggatctaagtgtgaaccaacaaggattatatctgtggagatatctctgagcagagagcaatagaggacaggaatgtgtgatgatctcggtgtgctaaagtggattacagctagggagggctgaagtgtgtgctaatgggagtcagggctgaatgagacctgtgtgcactaatgagggtcaggccatggtagaacagtgtgtttgtgtgtccctgcggaatagggctgagtaagggttcagggtgcactaatggggaggcaggactgtgtgaggcccggcgtgtgctaatagaaatcaggcctgagtgaagactcagtttgtgctgacagaggggacaggacagtggaaggactggaatgtgtgttaaggatggtcgtagctgtgaaggggcctgagtgtgggtaacactggttagagatctatctgtaaggttcactttatgttaatagcattcagagcagcatgaagaaggtccagtgagtgctaatgtgggtcagctatagagtaccccaagtgcatgttaatagaggtcagaatcatgtagggggaacagtacgttaatgaggggagtcagtactatggagaaggtaacaagcagctaggccagggaggggcccaagaatgtggtggcaagagttacttagaggaggctaagtgtgtgctgacagagttcagggcggtatgttatgtgttagggctttgaatgctgatgggtatatgagataatagcaggtaagatgtagtgaggcctccttgagggtctagcgtgtattaatggggatcaggacatagggtgcgatgaccaagtccttagtggttggtgtgttgagtatccttgagtatgagagtagtctgaggatgggtgtatgtctttggggatcaggaagggtcaggcaggacatgtgccttttttggggtaaggttttatgtccagtttcttgctccctccttttttgaaatctaaaaagctcattcaactgaaatgatatttaaaagtttccttgcgtataaatgttcaattatctctgttcacaggggcatgtctgagacccccatccccctttctgggagtgttatgtgatatacagattttacaccccatcttcctaaaatcccaaaaaactgaactccagagcatgtccagcccttggggtttccagttagaggtcgtggacccatggctcctcctggcttcctccccatcctccattcagccctacttccagtctcccccagcccctccactactccctgtcacaacatgcaaagcaactgggtatctgtgccatatggggacacaaggttgtctttgggagctggccatgctttaccttccttgccttaggcccagtattcagcctcccaggtcaggatgttttgtggttatcctgggttctccatggatggacctcatcctgtatctgaggtctttctgctagggtggcccctacccctcctggggatagtgagttcagccaggtgggggcgagaactgctgggggaagcacctgatttcaaggtagcagatgacccatttctctcctcaaatccagccccagtctcatcctcgacctcctatctagctctacttcccttgggcccagggccatcttaggccctgctgtgagtccagatggttcctgggtcaggtctttccccctccttgctggcccagagcccaagaggaagcagaagacggctggcctaagccttttggtggccccattcccttcagcaatccatctaggtcatcttcctgtcgatgccagcatccctgggctaccttgtttagggttgttcaatgaatagcagggactcatcacctcagcagaggttggtcctaggccctcagccccctgattcacttatttctgccataagcactttttgagcatctactctgtgtcagtcactattccaggtcctcaggatatagccgtgacctaaacacagaaatctaccctggcggagctgatcttctagttgtggcggtgaggagatagacagtaaagactaaagaaaccaataagtaggtggtgtcatttctgaggaggtaatgagtgctggggggataactggcaaggtgagggagttcgggatggttgagattttaaatagggttattcacagaggcctcatgaaaaaggtgacctttgagcaatggcccaaagggagaggggagtgagccatttcgaaatttaggggaagggtgttccaggtaccaggaacagccagtgtaaaggccccgaggtgggactctactgggtgtggttgcagaacagcaactaggaatgatggcgggggggtgtgggggtgggggggggccgtgggcaagaggcaataggggcaaatgaggtaaagaaacacctgtgggccacattgaggactggggcgtgtatttggggtgatgaaaaatgtacattcttgagtagaggagaaatgtgacttggcttgtaaaagtctagattggaccctaggggtcctaacctgatcaaaccgttctggcagccctgagaagagctggtgtacactgagacccccccgccctccacacaatcccacccagtggttgggtctgggcaggacaccctgacacacgctcccctccccccccccacctgggtagatgaatgggatgatgcagtggttgtcatgacgatgagtgctagagaagtcaggaagagggtccctgtggccacagggaatagtctgccttggcctttgagggtggtgctaggggaactatgccactctatggccgtgctcgagaccatgtcacccatccttcaattctgggcacacgccctggccgacccatggctgggcccatcactgcagctgtacctgagaagatctgcaatggagccttctgctcctgcagtggggcttttcccctagatcccaacaatccatcgttagggcccttgccctcaatcagccacctaaatctgagaactcaggtgggctacgtaggagcagggtcccagtggggctggctgtgtgggtgggcaggtactgacaaagatccccatccatgctgggtttccagaactcctgagtggctctggggtccatagtggttgagtgagcactgacaagttcatgtcagtgccccctgctaggctgtgggctttagggaacccatggtgatcaagcaaatgctaataagagacccatttccatccttgtcccttgctcagatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccaggtgggtccactggctatcccctctcccatatggccccaggctgcttcccaggtgttgcctcctggtcacattcctcattttcctctaaattttctgccctttctctgccccccatgtgctctcttctcccccttccctcccatcttctctcaacaccgtctgtctatctgtccatctgcgctcctcttcttgcctttctgcccaggccccgtggtgggggacagaaggtgccttgcctgtcacagctgccccaaggctccctctgcccttctgccctctatgatggcctcctcagtcctctggtacctgcctgccctgggcctgccttcccaggacccttggcttcccctgccaccacctagctgccggctctgagctcagcttgcccttggaaggaagggttccactaggtgacttttgcttccccaccccccagttcaacctgccctagatgtacctgagcttccctgggctcaggtacatcaccctctccccgagggactccaggtttcctgtgggggccacgtgcacacatgtgtgatgatggaatatgtttcgtgggggatggggtgtcctgtggttcctgaccccacctggcctgccctacccctctccctgccaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggtgcttgaccccgtctggatggtggaggaactggaaaagggggttggacctggggaggtggagctcatgatcctgtttctctcttgccttacctgctaggacatcaacaagcgcctatcactaccagctgacatccggctgcctgagggctacctggagaagctgaccctcaatagccccatctttgacaagcccctcagccgccgcctccgtcgtgtcagcctagtaagcaccttctgttcccgtcctctcctttttcttctctcccagacccttctcctgagccagctttaacctgcctcatttgtcccacagtctgagattggctttgggaaactggagacctacattaagctggacaaactgggcgaggtgagaggcaaataggaggcccatggtggggatgaaggtcagtgggaactcctggaatctcatagcacctctcctgtcacacttcctcacattccagggtacctatgccaccgtctacaaaggcaaaagcaagctcacagacaaccttgtggcactcaaggagatcagactggaacatgaagagggggcaccctgcaccgccatccgggaaggtacacacccccatcccatctgccccaggcttccccaacccacccctggcgcacacactccataatgagaacaaagactggttctaagaccccccaaaacactctggctttcatgggaatgcctgtcacccacatatccaggtaataatcagggtaaccaggaatctgttcccatttggataaaaggtagatgaattgcaaaccagggtttggttctgagaacacccctgaaagtgctcaccagtttatttactgtaacaatttctagtcagaatatcacatggaatgaatttgaattgcactgaaatttagtgtgcaaattcgatttcacgcgatgctgcaggcctatgtactgagggttggagccaggccccttcccagaaaccaaaaacaggttgtgaaaatctagtgtcacatgagcctggggctgcaatcccaggttcttgctccatactctcctctgagtcttattttccacatctgcaacatggagacacaactttcttctggcatgaggcgggttagagctggtggctccgaggcattaccctgaactgtctagagaaagaaagaaaacctgggcttgtccctttctagtccttgtcctcacctctgtcctgagggtaggaccctgactcttcccctgtcccactcccatgcttcctgcagtgtccctgctcaaggacctcaaacacgccaacatcgttacgctacatgacattatccacacggagaagtccctcacccttgtctttgagtacctggtaaggttgagtggcagtaggtcccagggggaggtgaggagaaggccaggagccataggaagtaaccctcattcctgtaccacctcttctttcctcaggacaaggacctgaagcagtacctggatgactgtgggaacatcatcaacatgcacaacgtgaaagtgggtgtggggcaggaagcaggggcacaagggggcccccactcacccactccaacccacaaatctcccagaaacggacttttccctttggctttttttgctaggagcccttggagggcactgggaccctgtcctcttttgtgtgacaaggctctgggcctagtgtctgtgtttgggaggggagcagtgcctgctgggggtcgggctagtggatagtctttgacctctgcctgccattcctgggtccccagctgttcctgttccagctgctccgtggcctggcctactgccaccggcagaaggtgctacaccgagacctcaagccccagaacctgctcatcaacgagaggggagagctcaagctggctgactttggtaccactggcctcccctttcttattggctccccagcctcctactttcccatgaccacttagtctcacttcccttcagccttgccagattttgcctaggacaccctcagtctcaactgcactctccccgagactttgcccatgactccctcattctagctgtcctttctctgatttccaggcctggcccgagccaagtcaatcccaacaaagacatactccaatgaggtggtgacactgtggtaccggccccctgacatcctgcttgggtccacggactactccactcagattgacatgtggtaaggacaggtggaagtgtggcaggggccatgtggtaaagggggtggcttggtcacaacagccacccagccagctgcctttctattcactgtgccctccctgcccaggggtgtgggctgcatcttctatgagatggccacaggccgtcccctctttccgggctccacggtggaggaacagctacacttcatcttccgtatcttaggtgaggaggcatgggccctaggcgctgtggagacacacggggaggacctgtgaaatgtttgggataactcctcttccctactaggaaccccaactgaggagacgtggccaggcatcctgtccaacgaggagttcaagacatacaactaccccaagtaccgagccgaggcccttttgagccacgcaccccggtgaggctggtgggtgggtgggcgttaggggccagagtgtccaaactcattttaaatcaggtctctttgtccttgtggcagacttgatagcgacggggccgacctcctcaccaagctgttgcaggtgagaccaccttgggtcagccttgggggtatgggattccaagtgtggggaaacagggaccccccccctcaaaccaggggcagggtctgaggtgggcagagagacctacttgttgaagatatcaatactatccccctccccgcacccccactcagtttgagggtcgaaatcggatctccgcagaggatgccatgaaacatccattcttcctcagtctgggggagcggatccacaaacttcctgacagtgagtggagctggggaatggaccggccagcgtggggactgggaaacaggactgctggggccagctggcgggttgtgtaggattctggctgtgccacctctacgtggggggacatcttgttcacgtgtgtgatgggttgtatttgttatgaaaacattttttagttttcagttccttttacctttcatgaaaaatttaaaacatacataaaaatatatgcaatagcactttactttttttaaagtagacatttccttacatgtgctaaaaaatgcacaaatcataagtatactatacaatgaattttcataaatgaaacacatccttgtaactagcacaaaagtcaagaaacagaatgttaaaagctccccacccccagctcccttgcatctccttcagttattcccagccccttcccaaagggtggccactgttttgacctctaacagcaaggataagttttttctgtccttgtactttatagaaatagaatcacatgtgatgttctttttatatctggcttttaaaaactttttaatatggatattttcaaatatatgtatttatatattagtcaaagtaatatgatgagtccctaagtactccagtgagtcatcaattcatggtcaatctggttttatctatattctctctgattattttgaatcacatccaatcccagacatcatagcatttatccttaaataatttcagcatatacctataaaagatttttttaaaacaacaatattattatcaaacctacaaaaaacatttgctcactttccctatcttcccactggattaatatataaagcaaaccccaaacaccacccatcacctagacttaacaggtggtaattgcaataccataattcacttgacaaagttaataatgatttctttgtgtcatgtaatagtctatatttcatcttccctggttgtagctggtttgtgtatggaattgtttgacagataaaggtcaagcctctcagagaaggggcagctttttctaattcttcccatggggtcatatggggctggtcctagatgacctcatgggtcatcccccacttctatgtctcccccatctgtagctacttccatatttgcactaaaggagattcagctacaaaaggaggccagccttcggtcttcgtcgatgcctgactcaggtaggtatagccccttgtcttcctccctgccccacccacctacctgcttacccaccaacagccatctgctctgctttcccccacaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaaaagcctgcttgcaaatccctgtaggggtggagggtggccgagctggggtgattattgggaccttggagaattcatacctcatcaccactgtctaggaaaacactgggagtgggccagggacacgtcacgactatgaaaaaggcatctaaggtattgcatatgtaacagtagaacatggagttgaagcaggtagggcaggctgaatggtgttgatgggttgagaagcagaaaggggagttagatttgcccaggaatatgaggaagcctgataagagggtggaggcagggaagtggagagacgatgtttgaaagacactggacggcccaatagaaccatggatgggaagatgaggcaaaggcccagtatggccatctgactaggaaaccatgaagaggagggaatgttcaggacggtagggggtagattttggaccactgagtaggtagagaaatcctttaatacatggatcaaattaagcagtggggccatagatggacctggaaatttcaattattagtgtccaggaagtaacagaaaccatgggcatgggtgagagagtttgcaagaggccagggatcaatgacacaacctggggtttgccctcagatatgaggataattgaaacttattttctttgtcctgtgagttccagccccagtcccaccatcttgggcaaagccaaggattgttttctaagcagaagagggggtgagcagggccaggcaaatactgcaagtaatggcaaccctaattaagtggctgtttactaaagcccagtggtgggggcccatgaacttctaatcactctactgtgtgtgtttgttttttgagacagagtctctgtcgcccaggctggaatgtggcggcacaatcttggctcactgcaacctttgcctcctgggttcaagcgattttcctgcctcagcctcctgagtagctgggattacaggcgtgcacaaccacgcccacctaattttttatttttagtaaagatggggtttcaccatattgaccaggttagtctcgaactcctgacctcaagtgatccacccacctcggcttcccaaagtgctgtgattacaggtgtgagccaccaagcccagcctctaccgtgtctttctaagcactttagtgatgtttcagcttgcagcctcatggtgccatgatgactgccatgtccccagagatggaaaagcaagcagggaagacagaacaccttccttacctgtctgtgttcttttaacggctggaacttccacaagctcctcagcagacttcctgtgccatttcttggctagaatcagatgacatggccacttctggcagcaagggaggatgggaaaaggagggccttgcaaagggggacaggattgccaggctggatttaaaaggtctagaactcacccaactgctctgggaagtggtagggtcactggtgtgggcagaggttggcctctggaaggtggaaaaaaaaaaacggtctagggctgggaaaggaggtctcttggatttacctggctgcccagataaatggggagggggagtctgcagaggggcaatggggagaatcaattcagagaatctgacaagattcaactgggcttgaagagcagctatctgccatgtgtctgactcaactcaaatgccactttctttggggacccttaagtgaaaggcctgctccctttcctcacccagagcttacacaactgagtttgtgacccctcatctatgccaggtctgggctgggggctggaatcacagtaataaagacacaatccctgccccgcagagattaactgaaaataggtaaattatgaaattgtgagggggaagggaggttcgaaattaaagtcatcatcaacggggctggcagccccagcagaggaaagaatagcatagcctagagcagtggttctcaaccagagacatttttcccccaaaggacatttggtaatgtctggagatacttggttgtcctgaggggtactacttggtatctagtaggtagaggccagggatgctgctacatatcctgcaatgcccacaacaaagaaatgacagtgctgaggttgagagaccctggcctagtccaagggttctcaaactttgggtctcgggattcctttatgttcttaaaagtttaagatattcaaaagagtttttgcttatgtcatatagcctctggattcagaagcctctggataatcacactgtacacccctgagagaatgagagtgaaaaagtattgtgaaaatagttttcattttgtgaaaccccaagaggatttttggaccggtagacaggctgggaccactgggaccacacggttggagaatgtttggcctggtgtttaaggtcacagctctgaaaccagatttctcaagtctaaactgcagctccaccactaattagctgagggacgtttctggtactcagcgtccccattgttacccatgggtgacaaggacagtacctgctgcctgaggctactattttagtccaataaagcacttaaactgggcggacagctagtttagttatgattgctatgactccaacaaacatagggcctggggctaacttgtcttcaacaccttgtctagtgaataaatctagttcaggaagagaaacaacagcccgcaggcctcggtgggtctctggaggtggaaacctcttttgcattgggttttgatggtacaatgaagggcattctgatcaggctaacaaaaacactgctcccagggtaggagtcctagcccacctcgggaacctcagcctccactttccatgccacctgtgccctaagtctacagggcgttaggaccccacaaggcacttttgtctttcttggttcccactgaagattttaccccacctagcccttcgacgcgtctgtgcacggggccatttccaatatggcagtagccccgcgactgtttggggggctctgcttccgtttccgggaccagaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggtgaggctgggctgcggtggagcctcggcagagggaacggtgggggcattgacaaccgctggggattcggcggccgagggccgcgggaaagctgctgcggggtgcgggggcgggggagtggccggcgggacagcgggctaaaggggcggggaagtgcctttgaatgaatcgcaacgtctggaaaaggggcggggcctgtgtggtgcagtctgacgcctgagaacaaaatggggtttgttgtgatgagaccagtttcggtcctggaggtggggccgggcctgcgtagtgaaactgcgtaggaacctgggaagaaggtgggttctgctacataaggcgggggcgcggcctgcgctgcgtaatgcaacttttgggggcgaggagcggtttccgattgctccggggcggctgggaacgaggcgagctttgtgacgtcagcagaagagcgggatggagccgaacggtccgagggagggagcggggacctccgtgggggaggggggaggagcctggagcctgggaacgaggttaggttggtgacgtgagctgaggggcgtgctctgaggccgagggacgacagtggaggggaggtggtgcctatgaggcagaaaatggcgcctgcgaataagcaaagtttatgacgcgccgtggtttttgattctggcggaagccttcccgagtcgagagaacgtgcaggtgattagcaccggaggggccttccatgtttaattggttttctgtgttggtactgttttgtttttagaatcaagaaaaagtcgtttttttaaaaaatagaattttgataaatcggcttgttttactgatttcttgctaaacagtccttcttgaaatttactgcttctgagttcattttatttctcgccgagttgcatctcgttttttaattgtgaaatacgtaagacttaaaaagattatataaaacatttacgcagcccagattgacggacatcctgttaaaataaacggcctacactcttcaaaaatgtcaggatcatgaaagacaaaggctgaagaactgttccaaattgaaggaattaatgcaatttaacgagtcatgataactaaatgcaacatgtgatcctcgattggatcctggaacagaaaaaaaaattattttaaaaatcaattttttatcataagattatttttgtctcttttactgtaaaaggcaatggaaacgtcggtgaaattttattaaagtgggtagatactagtactactaataattgtgatcattgtggctgtgaaaaataatatccttgtttataggaaatactgaaaaatttagggataagaacgcatcgtgtaagcagtttattctcaaatgcctgaaaaattagcatatataaatttatatatggcgaggggaaataaaattggggagatgttggtcaaaggatacaacatttcagttagacaagaaaaataagttcagatctattgtacaactatagttaataaattcattgtatacttgaaaattactgagagaagattttacatgttctaccaccccccaaaaaataagtatgtgacgtaatggatgtgttaattgccttgacttagtcattccacaatgtatacataagtcaaaacttcatgctgtacactctaaatatatgcaatttttgtccattttaaaataaataaaaataccaaaaaatgcatgtaaagaaacaacgattgagcaaatgagtaaaatattagatttggagaatctggatgaaggacatatggggattctctgtattatttttgccatttttctcaatctatttcaaagtttaaaaattaaataataaataaaaacgtgtgaattcaccatccatgttaagattcagaacactgtcttaagaaatccttctgtgcccctcccagatggaaattcccctccttgctccatgggaaactgttatcctgaattttgagttaacagtctcttccttttctttaatgttttaccacagctgtatgcatccctaagcggtatgtattgtctaagctttcactttatacatatatggaatacatatatataaaattctactggatgcatactgtgagcccttatcttcgcatcgggtaatacatggtatccacatggcatcattggtgatgttaaccttgatcacttggttatggtagtgttggccagctttctcaactgtaaaggtaccattttcctctttacatatgcagtaattatttttaaaacatgtatcatgtccagccattcctcaaaatactcttaacagcttcccatctcttgcagcgtagatgctaaaatccttacaatgaattgcaagcctttatgaagctggtctcctgcttgcattctgatgtcttcccatatctctcctctgattacgcactccctccctgtctccatccaggccggccatattggactcttgctgttcctcaaacacatctaaccttagggctttttcgagtgaggtttactcactacagagttctttaataaccacaccagtgaaatgtgtatctctgttactggggagatgagttgagattttccaaatcgggaatacaaacccaagccgtgtttttctgccattacgtcacacttttccagcaagaaaaagcctcatttcatcctgagaataaacaaaataaccacagtgttttgtaactcatttgaagatgttcaaaagggccttgaggctttgatccttgcctcttcctacctttgtagccttgtgattgtgtcactggtaggacatgacatcctgtcatccttgataatacgctttaaaattaccccaccagtactgggttttcttttgggatgatgaaatattttggaactagggagaggttgtggttgtacaacattgtgaatgttctaaatgccgctgaattgttcactttaagatggttaatgttatgttatgtgaatttcacctcattaaaaaaattaccacaccagtgttggttcagtgttgaagccggtttgtctctgctgtcatgggtattatcatgaagcatttttgctaaactccactttgttaatgcttctctagtaagagcaaagcatctcaaggttctttattgctgtccattttccattttacaggggtttgcttaagtggccaggatatatgtgtttataaagcattttgaagtcatggactaaccccaaatcatatatcttgtatcagtattaatatttgcaccttctgtcttttgtcagctggcagatttgggtgagggtagttaattaatttggtcatcacaactgatttaatttctgggagaagcttgtattttaaggcaaattcaaatctgtaataatatagcctccttggaaattttcactttttccttttgtgggatgaaccatcttcaaacacaaatcagacacaagagaaaactagaagacagaaaataaagaattgtttagcaacttttttccataagcacatatttcatatcatttcaacaaatttgaggaagcacgaataaacctaagtgactttagcaagatcagttgtacctgtatatactggcagcaagaaactagaaaattaaaatttatgataccatttatgatagcatccaaaaaattgaatacccagctgtaaatataataatttgggtgttattgatacagaccatgacacctttgttgtgactgccacctggcctgacagagattgtgagacatcctgatttcagagatgttaacaatgatttttttaaagtgtctttgacttgaagcaatatggtaataattttctgtgaaaaattatgtaaaatgtcagtcctctatgaaatctatagaagttcagcctgtgaccaggtctggaagttttgcttaccactctacagcgtgattttaatgttattttttgttcaaaatctgctcttaaaaagaagttgagcagtgcctacctttgcattggaaggtactgttaactatagctttactgaacaaattaacttcatagactggctatggaggcaagtaaagccacaaagggtggatggtggtgtgtggggtgcagggttgggtctgagcattgagccaccggcacagaagggtttgtttccctggtgtgagtgatatggggcagggtctgtgggggtcagtgcagcaaaaaaacaaaaccaacaaaaaacccacagaaatgtttgcctatctaggtgacttgtgactattccaagatttgtctgtccctccatcctcccacctctctgatcctttcatgaacaagggaaagttgacattttaaagaatcacattgatgaggttaaattgggagaatcgcttgaacccggcaggcaaaggtcgcagtgagctgagattgtgccactgcactccagcctgggcgacagagcaagactctgtctcaaaaaatgataataataataatgaggttaaattgcttgaaaaccagccaatataatgttatgtgcatttcatcaaatttggttattttttaaaaagcatttatttgaggctgctcagtatttgggatagccttttatgtgtcagaaatgccacagcagaacaggtgtgtgtgtatgtgtgtgtgtgtgtgtgtgtgtgtgtgtgtgtgtgtgtgtttaggcaggaggaggtttatgtctgtgagcttttatgtccaagtcctgaagtccaagctgtcagaacaatgacagctaaaattcatttagcacttattatatgtcaagtattttccaaacttcaggatttctcacaaaggtagatttcaatatagttctaaatggttatccttgtagtacatataagtttcacctttaaaagagagctagttgaactgtatactgaaaaatgcttgatggtaagttttatgttacatgtttttatcacagtttttaagagaaccataagctcaggaatttactataaagccaaagtaaattctaaattaaaaaatgatgaacaatagcaatatgcagttcttttttttttttttttttttgagatggagtcactctgtcgcacaggctggagtgcagtgatgcagtctcggctcactgcaacctctgcctccagggttcaagtgattctcatgcctctgcctcccaagtagctgggattacaggcacgtgccagcacacctggctaatttgttgtattttttagtagagacggtttcaccatgtcagccaggctggtcttgaactcctgacctcaggtgatccacccgtcttgacctcccaaagtgctgggattactggcgtgagccactgtgcccggtcttttttttttttttttttttttttcagtatgcagtttttgaaggaaaaccttatgattctttttagcattttaaattctttgctccttttaaaagcagatttttcaccatttatcaaatctagttcttagctgaagaattatgcttccattgatagatcctttagaaacaaacacataatgaatggctaaagccttataaaattagctgcagatggcacatatcttgagcctaacttaactgggttatcccacagactaattcaaatgaatcatcttttattctataataaaacctcatgtttcctagcactataagtatggattttttgttggtttgtttgccattgttaaccacattttctgtttttaatcagatttcttttttaatactaagaagttatctaacatacaaatctgagtttcactgaataaattttgcttcgaatttatttttatatgatgctgaaacttttcatcttaaattataatgtgtcaatactttcagtctgttgggcatgggaagttgtatagctaaccctcagctacccatgtaacacccttgttacctgtctgggccccaggttccttgtggagaagcactggtataagcagtgggaggcatacgtgcagggaggggaccaggactccagcaccttccctggctgcatcaacaatgccacactctttcaaggtacaaggcctttgcctccttctcaccctagccctggagttcttgtcccttccgtccctacagatgatcataagcccattctgtgtgctaggtcactggtggggtggccagagtcattcgtcagtttcctttgttgattcttcctctgccacctccacccccgccccacagatgagataaactggcgcctcaaggagggactggtggaaggcgaggattatgtgctgctcccagcagctgcttggcattacctggtcagctggtatggtctagagcatggccagccacccattgaacgcaaggtataatggatggggagggtgcatggcggggagtgcgtagtaagaaagccttgtaggcccagcatgggtacagatccatgtatgctgggtaggtacacatatgtctgctctcttccccctcctagctcatcatacaggtatctttgtctgctgtgtgtgttcccctgtgtggctctctttacagaccattgtatatgtgtgtttgtatgctatgtttgtaaggcagagtgtgtgctcctctcatttgagaggtcacagcgctgtgtctgtgtgagtacacctgtgtctgcacccctctactcttacaggtcatagagctgcccaacatccagaaggtcgaagtgtacccagtagaactgctgcttgtccggcacaatgatttgggcaaatctcacactgttcagttcagccataccgattctattggtgagtctaagggtcacgcaatgggttggtgttcctagctactagtcccaactcagtgacttgaggttgcatagggttaagctgaagctgactgagaaggcactggtcagactttggaagacccagaaggcattggctaagttgggtggaggcactgaggggatctactagagccctgagggtatgtgagctacattctagtggcttacgtggtgtggcagaggatatttgctggagatctccagtctggagtgtgggccagtcatttggagactgattgaggacacaggtattggccaagcatgtgaggtccgtagggatgagtcaggtatgcccagatggattgatcattttgggtctcacaaagatcttgaatgtactccatcaccccgcacaggcctagtattgcgcacagctcgggagcggtttctggtggagccccaggaagacactcggctttgggccaagaactcagaaggctctttggataggttgtatgacacacacatcacggttctcgatgcggcccttgagactgggcaggtaagggtggggagggcttttctgttcaggtggactggcagatagactcacctggcagtactcgggggaaatgaaggctaggtacccataatgtcctccattaatacctttccttctttctctttctccaacccagttgatcatcatggagacccgcaagaaagatggcacttggcccagcgcacagctgcatgtcatgtgagcccttggggtatctggtccagagcgggggcgtcccacagtaggcaaaatgatttagcccatgagcacattgcacccccatgcagcaggccctcagctgacagtttctcatctaaccccaggaacaacaacatgtcggaagaggatgaggacttcaagggtcagccaggcatctgtggcctcaccaatctgggcaacacgtgcttcatgaactcggccctgcaggttgggccattatagttgtgtctggcacagccacgtggttgggcttcaagagctgaggattggggacagagctggggtcctgaggggactacagggcaaggggtcaggatgaaagctgaggccccacaagtctgaagtggcacgcccacgttcattcctgaactatcagcctcttctctcagcttgccctcattttccctcttctcttccctgttcccacgttcttccttctcgtgaaatcctaatgccttctctcccctactctcctgctcctctctctcctcccttccccttctctcttgttttcctctctctttcctcctggcttctttttgtgtatcctcactttgaaccttctgtctcccctctgcctcattcacctggtctctggcctctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaaggtgtgactcaaccctgggcacccccgaccccctacgtctcttggctctcctaactccctctctctctgatgaccctgcccatcttcttagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggtaggctgcccccgcatttgcagtccaattaacatcaccaaggcctctgcctcggggattttctggcctccctggggtatctaacacgccaccattttctgttaagtttctctacctgacctcaactccagccttactcttaaccttagttgcaataccatatctgcccccacagtcaacccagagtaaaccccagcgcagtctcctgccctaaatgacccccagtcttgaccgtgaacatagtctctgtgtatccctagctggagctctgcctctggactttagcagtggccttccgcttcaccccatttgaatgcaccccaagccatggtttcctcttaccctgggcaagccccaccacccaccatgacactatcaacaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcaggtgtggggcagtgggggcctggggagatgatgatggacacatagagtttgattagctgccatagctcaaggcttcttgcattaactcaccacaagcccttttggtcttttgtggataccgtttttcccttagcaccggctcgtggtccccaagaaaggcaagatctcggatctatgtgtggctctgtccaaacacacgggcatctcgccagagagggtgagactgcagaaggaggctggatgggattccagggcaaggaggcagaagggcctgggaggccgtgcagactaacagtcccctctccatatcccattcctagatgatggtggctgatgtcttcagtcaccgcttctataagctctatcagctagaggagcctctgagcagcatcttggaccgtgatgatatcttcgtgtgagtggggatggcagggaggtggtggttcctcaggaacttggtccacttccttttgtatggtcctgccttaaccaccttctctcttccctgcctctgcctcgttcactgggcacctgccctgcgcagagcttcagccacatgccttgggaggctgaggcaggagaatcacttgaacccgagaggttcaagtgagccaagatcacgccactgcactcc[224 bp omitted]gaggcaggagaatggcatgaacccgggaggcggagcttgcagtgagccgagatcgtgccactgcactgcagcctgggcaacagagcgagactccgtctcaaaaataaataaataaataaataaaaataaaaatgccttcaggctgtgaggatgagtgggtggggcagccagggcagagtcagggagtctctgggggccctgatcaggtgtgcctgctgtccaccccccacagctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcgtaagtgtcctcttccccgggggtggggggcggaggggtctgaactccgacttgggtgtttagctgcttatttgacacctcccctgtaacaaacaaaagacagtccaaacttaacatggccatagaagaacttgtagggttttttctttctctagacctctggctttgctactgcctgtcttgggtgctagggatacagaggtgaacaagatgcacaaaacagacaacttcatcttgtcttcagttgtctctcctggagactgttgtccctcctgggagagtcttggtttttttgtctttttgctgacaaattttcattttgcctaaaatctagagtctttactgtggcacacaaagcattgtgttatcagaattctcccccctcattttgcattcaaaagtcattccccagaggctttccctgatgggaagttacagccggtatgtgtcttgtctagcagtggcttattagagtaaaagtccacgctccatacctttttttttttttttttttgagatggagtcttgctctgttgcccaggctggagtgtagtgacatgatcttggctcactgcaacctccatctcccggattcaagcgattctcctgcctcagcctcccaaatagctgcaattacagccgcgcgccaccacgcccagctaatcacactccacacctctgactgggacacaagttccttcattctcaggccactgctgacagccttggcctcttcatgcatttacgcgtcaccccttcagccctctcacacctcagattcagaacggtttacatgtggatctaccaatggcttcccattatcttaagtaaaatcccgggctctatccccactgtccttgtacccgtcttgggagtctcctctgctctgttgcagacgctacgtgaccaaacccaactcagatgatgaggacgatggggatgagaaaggtgagggggctaacagtcagtgggcgggggctctgggttaggtctgacccacgtagggttcgtctaggtgtgcattgcagcttagcacttgaggctcacaccttcccatctctgacatcctcctgtcctagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatggtatttcctttggctatcagcgagggctggggaggctggaggggagatttcctggcagcaggatccatgaccacctctccctcacccccagcccagccgtacattgctatcgactgggagccagagatgaagaagcgttactatgacgaggtagaggctgaggtaaatgagatcccagggatggggggtacttccagctcttgcccctcaactcttcgtacatcctccccacaactcctctagctgggaacagagccaagagatccaggtcaagcttggccttggggcctgaacacctactgagagctccagggcctgaggttcctagcttcaaagtcggtgctctgacccactcagtgtgtgtctcccccgctgggcccccactccccatttctccatctgtcctcacagccggccatctggttgtctgttcacccaatcctagggctacgtgaagcatgactgcgtcgggtacgtgatgaagaaggctcccgtgcggctgcaggagtgcattgagctcttcaccactgtggagaccctggagaaggaaaacccctggtgaggggccagagcggggcctgtgtgtgggggtttcattggatggaactactatatttagctttttttttttttttttgagacagagtctggctctgtcaacccaggctgaagtgcagtggtacaatctcggctcagtgcaacctctgcctcccaggatcaagctgttctcctgcctaagtctcctgagtagctgggattataggcacccactaccatgcctggctaatttttatatttttagtagaaacaggttttgccacgttggc[132 bp omitted]cacactcaaacccttcttgccaacctggccaccaatctcctgagcagactcctaccccagagccttggcctgtgctgttccttctccaggaatgttgttcccagtgatctacaggacttcactccttacgatgctcaggtctccgatcaaatgtgacctcatcagagagacctcctctgactaccctgttaaaaatcacccttccccaccatccctctccatcccctctctgctcttttcttcctagccaagcattactttctagctcagcgatgccacttgatgtgatgtcctgtatccacttttgtgttatttgtcatcttcgttagagtcaactcctcgagggtgaagacttaagttcactgtgtgttgcttctacctgtttataatagtgttgagtgttcggttgatgctcagtagacacttgcagaataaacaaaaagagaaccaaaaccacactccctagtctcagaaataagagcagcatgtccgtggagcagaaatggaacagaaatacaaaatagttccaaagggttaaacaagcaatcaataaatactggggagtgaatgaatgactaaaatacgaagagaggaaactagaaggatagaggtgggctctaaaataagactagcatctcatggaacagaaatcaaacaaaaatacaaaaaatagtatgagcacatatacaaaagatagtaagcacttgacgagtgagtgaaaggattttaacaggaacagagcaaactagaatactagatgggctaatagtaagagcagtgtttctgtgagccagacatggcacgtgagaggcagtacaaagggcgcacagtaggtgctcagaaaaagtctgttttggctgggcattgtggctcatgcctgtcatccgagtaccttgggaggccgacacgggtggatcacctgaggtcaggaattcaaggccagcctggccaacatggtgaaaccctgtctctattaaaaatacacaaattagcagggcatggtggtgcatgcctgtaattccagctactcgggaggctgaggcaggagaatcgcttgaacccaggaggtggaggctgcagtgatccgagatcgcgccactgtactccagcctgggcaacagagcgattctctgtctcaaaaaaaaaaaaaagaaaaagtccgtttgctgactcgggctctgtctgtaggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccggtcaggggccagggagaggatggctgggggaaggcagggaaaggagggggtgtaccagtattaaccctctccccacccacagggacctggacttctctgagtttgtcatccagccacagaatgagtcgaatccggagctgtacaaatatgacctcatcgcggtttccaaccattatgggggcatgcgtgatggacactgtatgtgccaggctgtgggtggggcctgccctgggggttctgggcaggggggcgatcaggaccttcccagtgagtgactagggatgtgagccagtggtgaggttatcgtggtgggaggagtgacaagagtgaatctggacacttctgagaggcaggaagggtaggcgaggataactctccttccctttcagacacaacatttgcctgcaacaaggacagcggccagtggcactactttgatgacaacagcgtctcccctgtcaatgagaatcagatcgaggtgtgacttccatcctacctcctccccttcttcctttctgattccacctccccacccccacaatccacactgactcctgtcctctccccacagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctccccactcagcagtgtggttttttcctccatggacttaactaagcaccagttttgtgcctgtgttctgtgttcttatcaaaggccagatgtgtgatgggtgcagctctgagtggttagtgagcaccagctgtgggctgggtactgctgttctaagtgctttgaaagcaccctctgtgtgccaggcacgattccaagcaccaatggcatgcccagttttttccaaaatattttccaaatattgatacgtaatcctcacaacaatctcatgcaagagttgtcatctccagtttcggatggggatactgaggtacagaggtcacagaattgctcagggcttgtcaggaggtcagtatacctcatgtgctacccgagtcggtccctggagtgggtgcttggcttgtctggacccaggactgctactcaatctgcagacatgagctgccctacaggcaatgtggaaatggagcacgtgggacggatgcatccatgtgggcaaatttgtggtttggggacataaaaatactcctctcaggccaggtgccacctgttatctcaacactttgggaggccaaggcaggaggatcacttgggccctggatgttgaggttgcagtgatctatgatcgtgccactgcactccagtctgggccacagagcaagaccccatctcaaaaaaaggatgctattccccagaccacctcacagacccccagtagtgtcctctgagaagattttgtccccctgagacctcctttggagatggtacatgcatttggcagaccagccaacctgccaggacaaatgtgctgtctgtgtgtggcccctgtagtcagccccctctcccatcatgaccccagctcccacaccaggcaggttccctccaacctcaccccagacgacactgaacacctgccgcaggaatttggacataaataagccatccaacccttcacactgatgggtgaggggaatcctgatcggtggcagctgagaggccattctcatggccagggcctcaacactccccccagccttctgcctttgcactgggtctgggcagacccactgtgagggtcactcagccccagcatcgccacccgcaaacctcccagtcactctgctgacacaggcagaagtcaaggcagttgctgtgaggagcccagctcaaactgacttagcaaaagtaagaacagaaatactagtttcaggtatgactggatccaggaactcagaagctgtcatcgaaggctcgtgaagaccatatgactgaagcactacaatcaccccattttgcagataaggaagcaggcataaagagctgggtgagaatgggctgtaagggccaggcgcagtggctcatgactgtaatcccagcactttgggaggccgaggtgggtggatcacctgaggtcaggagttcgagaccagcctggccagcatggcgaaaccccatctctactaaaaatacaaaaattacccaggcatggtggcacatgcctgtaatcccagccacttgggaggctgaggcaggagaattgcttgaacccaggaggcggaggttgcagtgagctgagattgcgccactgcactccagcctgggcaacagagcaagactccatctcaaagaaaaaaaggatatcatactaaagaacagaaaaatagtaagtttcaaacaaacggggagaatagaatgaagaataataatccagaagaaggcaagaataaagaaatagagaacaggtggacaaatagcacgtacacaacaatttgcagataagatctctgctccctccagttcaagggagggaactgggaatgaggcagctgctttgagactgatcaagactgccatcgtgccaggcagacagtgggggaagggcaagtaaaaatgccacaatactcccattttgaagatggctttttcttggttggacagttgctgtaaactttttttttttttttttttttttgagatggggctcgctctgttgcctaggctgcagtgcagtggcgcgatctccgctcactgcaagctccgcctcccgggttcaggcctttctcatggctcagcctcccgagtagctgggactacaggcgcctgcaac[187 bp omitted]gctgtaaagaaatacctgagactgggtaatttataaagaaatacccgagactgggtaatttataaaaaaggctcatggttctgcaggctgtacaggaagtatggctgagaggtcttaggaaacttacaatcacagtggaaggtgaaggggaagcaggcacgtcttacctgccctgaagcaggaggaagagagtgaagtggggaggtgccacacacttttaaacaaccagatgtcatgagaactcactatggtgagaagagcaagggagaaatctgcccccatgatccagtcacctaccaggccacttctccaacaatggggattgcaatttatatgagagttgagcggggacacaagtccaaaccatatcaactattttccagcactctgacacagttagctctaacaattctgtttgctttttgatgtttctgttaaggagccagagcctggagcttcctagtcttccattttggtgacatcactcttttttttgagatggagtctcactctattgcccaggctggggtgcaatggtgccatcttggctcactgcaagctctgcctcctgggttcatgccattctcctgcctcagcctcctgagtagctgggactacaggtgcgtgccaccatgcccagctaattttttgtatttttttttttttttttttttttttttggagatggagtcttgctctgtcgcccaggctggagtgcaatggcatgatcttggctcactgcaacctccacctcccaggttcaagcgattctcctgcctcagcctcctgagtagctgggattacaggcacgcgccacgacaaccggctaatttttgtatttttagtagagacagggtttcaccatcttggccaggctggtctcaaactcctgacctcgtgatccacccgcctcagcctcccaaagtgctaggattacaggcgtgagccaccatgcccggcctaatttttttgtatttttaatagagacggggtttcaccatgttggccaggatgatctcaatctcttgacctcatgatccacctgccttggcctcccaaagtgccgggattacaggcgtgagccaccatgcctggctgacatcactcctcttctgtgttatgggtttttttttttttccacacacaacatggatttttatcttttctttttcttttcttttcttttttttgggggggtggtataggatctcactatgttgcccagcctggtctcaaactcctgggctcaagggatcttccctgccttagcctctcaagtggctggaattataggcctgagccactccactatgcctagcccgctttatcttttcttggcttatcaactataactcttagatttttggtttgggtttcttttttttaaaaaaaattattattattatactttaagttttagggtacatgtgcacaatgtgcaggttagttacatatgtatacatgtgacatgctggtgcgctgcacccattaactcgtcatttagcattaggtatatctcccaatgctatccctcccccctccccccaccccacaacagtccccagagtgtgatgttccccttcctgtgtccatgtgttctcattgttcaagtcccacctatgagtgagaatatgtggtgtttggttttttgttcttgcgatagtttgctgagaatgatggtttccagcttcatccatgtccctacaaaggacatgaactcatcattctttatggctgcatagtattccatggtgtatatgtgccacattttcttaatccagtctatcattgttggacatttggattggttccaagtctttgctattgtgaatagtgccgcagtaaacatacgtgtgcatgtgtctttatagcagcatgttttatagtcatttgggtatatacccaataatgggatggctgggtcaaatggtatttctagttctaaatccctgaggaatcgccacactgacttccacaatggttgaactagtttacagtcctgccaacagtgtaaaagttgggtttcttgtttaatttttagagacggggttttactctgttgcctaggctggagtccagtggtgcaatcatggctcactgcagccttgacttcctgggctcaagcgatcttcccagttcagccccccaagtagctaggactacaggcgtgtgccaccatgcccagctatttttttttttattttttgtagaaatggtgtctcgctatgttgccagggctggtctcaaacttctgggctcaagtgagcctcctgcctcagcttccccaagtgctggggttgcaggcatgggccaccacgcccagccaactgttggttttattttagcgattgctttagggtttatattattcacctctaacttatcatagtctaccttcaagtgatatataccactttgcatacagtataagatgtttagtgtacttccatttcttcttgctcagcctttatgctgttgtatcatgcattttacttttacgtatgttataaaccccaaaatacactgttatttttattgaaacagtccattttcttttttcttttctttttctttttattgtgagacagggtctcactctgttgtccaggctggagtgcagtggcaaaatcatagctcactgcagccttgaactcctgggctcaagcactctttccacctcggcctcccaaagcactgggattctgtacacatgaaatacaattttttggccaggcgcggtggctcacacctgtaatcccagcactttgggaggctgaggtgggtggatcacctgaggttgggagtttgagaccagcctgaccaacatggagaaaccccatctctactaaaaatacaaaattagccaggcttggtggcacatacctgtaatctcagctactcaggaggctgaggcaggagaatcgcttgaacctgggagtcggaggttgcggtgagctgagattgcgccactgcactccagcctggcgacagagtgagactctgtctcaaaaaaaagaaaaaagaaaaaagaaaaaaaaagaaatacaattttttgtagagaggagggtctctgcaaaaagctactgtgccctgactcaccttatttttttaaagatattttcatgagtatagaattttaggttgacagtttttaaaaaattttttattactttgaagattttttgtttttgtttttgagatggagtcttgctctgtctcacccaggctggacagcagtggtgtgatctcggctcactgcagcctccacctcctgggtttaagcaattctcctgtctcagcctcctgagtagcttggactacaggtgtatgccaccatacctggctaatttttgtatttttagtagacacggagtttc[142 bp omitted]atctgatgtcatccttctctttgttcctatgtatataacatgtcccatttttcccactggctgcatttaagattttctctttagcgctggttttgagcaattccgttatggtataccttggtgtaattttcttcatgtgtttgaggtcgtttgagccttctggatatgtaggtttctggtgttcatcaaatttggaaaaattttgtccagtatttcttcaaaaacaatttttttttctgaagttctcctctattttccttcatggatacaaattactcataaattagactgcttgaagtcccgtggctcattgatgctcttttgaatttttggagttttttttctctgtgtgttttgttttcaattgcttttattgctatgctttcaagttaactaatatttccttctgcaatgtctaatgtgctattaattccattcaatgtattttttatatcctcaatgtctctatttaacttttttaacatatggcatactctgaattgtttttcctcagaacacttctgacaccaaatgtgtgggttttttccataccaacaaccagttcgccaactctccagatgccaactgggtgtccaacaattcaattcaattctaacactaactacctggcattggtgtcagaccccacaagttaagggcttggtcccacataactgcctccacttgagacaccaattgaaaaccctaggcctcccatacttctgattgatcggctgtaaatcaggggttcccacaaccccttcctcgggttggataatttgttagaatggctcacagaactcaagaaggcacattatttactatgactggtttattataaaggatacgactcagggacagctaaatggaagagatgtataggactagatatggaaggggcaccctcccagcatgttgatgtgtttaccaacccagaaaccctccaaacccttcattcaggggtttttatggactttccatcatgtaggcatgattgatgaagccattggctggagatggatgattacctcaatctccagaccctctcccctccccagaggcccagggtggggctggcaaacagcccttatttgaagctatctaggggccctccaagagtcacctcattagcataaactcagggatgatcataaactcagggatgattgaaagaggcatgttatgaacaacaagatgatcctctcacctcgccattcaggaaattgtaagagttttaagagctctgtgccaggaaccaggaacaaagaccaaatatatacttactcttatatcacaatatcacacataaagttataataataattgtattaatgtccttcactgctaattctaacatccttgttggttctgagtctgttttgattgattattctcctcattatgggtcctttttcccttcaaaggcattcctggtaatctttggttggatctcagacattgtgcattttaccttatggttgctggatattttgtattcctataagtatcctggagcttttgttctgggatgcatttcattgtttctttctttctttctttcttggctgttgtgaatagtgctgcagcaagcatgggagtgcagatatctcttcaacatgatttcatatccttcggatatatacccagtagtgggtttgctggatcatatggtggttctattgttaactttttgaggaacctccatacacttttccataatggctatactaatttacattcccaccaacagcctgcaagtgttcccttcatgccatatcctcaccaacacttgttatcttttgcctttctgataatagtcattctaccaggtgtgaggtggtatctcattgtggttttgatttgtatttcactgatgattagtgatgttgagcatttttctcatatacctgttgaccattcatatgtcttcttttgagaaatgtctattcagtttctttgcccttctttttttcttttctttttttttgagacggagtctcactctgtcgcccaggctggagtgtagtggcacaatctcggctcactgcaacctctgtcccctgggttcaagtgatcctcctgcctcagcctccctggtagctgggactacaggggcactccaacatgcgcagcttttgtatttttagtagagatggggtttcaccctgttggccaggctggtctcgaactcctgatctcaagtgatccacctgcctcggcctttcaaagtgctgggattataggcgtgagccaccgtgcccggccaactttattctttttgctcaagatctcttggcttttaggagcctctctctctctctctcttttttattttcctttttccttagatccagggacagactggatgttctgggtcttttgtgattccatataaattttaggattgttttttctatttctgtgaagaatgtcattgttttctgggtttttttttttttttttttttttttgacacagcgtctcactctgtcacccaggttggagtgcagtggtgtgatctgggctcactgcaacctctgtctcccaggttgaagcaattcttatgcctc[134 bp omitted]cggcctcccaaagtgctaggatcacagacgtgagccactgcgcccggctggtattttttgttttttgagacagagtctcactctgttgcccaggctggggtgcagtggcatgatcatggcttactgcagccttgatctcctgggctgaagggttcttcccaccacagcctcccaagtatctgggaccacaggtgtgcaccaccacacctggctattttttaaaaatattttttgtagaaacaaagtcttactgtattgccccggccagtctcaaactcctgagctgaagagatcatcccacctcagcctcccaaagtgctgggattacaggtgtgagccaccacgcccagtcaaattctttcttctgaggaggcaagaattgaggttgctgtagacctggacagatttgccactgctaacaggctcacatcatttgtttccactgtcctccattttctgatgttattgttttgaaagctgtcattgcatgtattttgtgtaaatctattgtttgaagcaggtagtaagtcttgtccctgttactccatcttgaccagaagcagaagtgctttcccacaacttttacaaatgtactttgctcttcttctttttcatttcttgagatagaggcttacttagctcagtacttattcaaactttttgccttgatatgtttctaatcatagatactaaaagacagcaaaaactccatatacatatatttattacttttaacactgttggatttttataattctttatatccaaaaaatgtaatccattttgtgaaatgcttacagtcttttttgtgtgtgccatcacagctctcatcattaaaaatgtttccttagcaaccggacaaaaattgatatcaacatgggtacctatatgattttaaagtttttcttactgcaccttttaaaagttgcacattctggccgggcgcggtggctcacgcctgtaatccgagcactttgggaggctgaggtgggcggatcggttaaggtcaggagtttgagaccagcctggccagcatggtgaaaccccatctctactgaaaatacaaaaattagctgggcgtggtggcgtgctcccgtaatcccagctattcaggaggctgaggcaggagaatcgcttcaacctgggtggcagaagttgctgtgagctgagattgcaccactgcacttcatccagcctgggcaacaaagtgagactccatctcaaaaaaataaaaaaataaaaggctgggcgcagtggctcacacctgtaatcctagcactttgggagcctgaggcgggcagatcacgaggtcaggagttcgagaccagcctggtcaatatggtgaaaccccgtctctactaaaactacaaaaattagctgggcatagtggcaggcgcctgtaatcccagctactcgggaggctgaggcataagaattgcttcaacctgggaggcagaggttgcagtgagcccagatcacaccactgcactccagcctgggcgatatagcaagactccattaaaaaaaaaaaaagttgcacattctttcagtgtaataaggagataggacagagagaaatacagaaattaaaaagagaagaaggcagatgaaaacaaggagaaggaggaatagaaaagtagggaaaatgagtagcacatggacgacctttacagaaatggcgtgtaatccctcaccatttctgaatctttagttaaagtttccatagaatgcaatgcatagctgatcatggtccacatgcatttgccacccaccccactgatctgatcactacctgtgttagctactctataaaatggtaaaaacaatatgtaacaacaccatagaagaaaacttaagtatgaatatagctttttggtattgttaaaaatgaacagtgtctgaaaccagggttccaagggaccacccagttttttcccattgtcatagacaatctatgtcctaacttctgagcagctctagaatcttgtttcttttcatcctagaacccaacaacattttggtgttggtttgctatagcactaccctggctgagggtattttctgcttctttctttcccaggcagtaggcttctctgtgcctagctggtaatggggcagaggtggagaggactcttctctttccaaaaggaaattgttctgaaggcagcagattttgtgtcctcttggtaacactactgcctcttcccaaactcctgtccttgtctccagctttaaactcatctcttttcttttcttttttcttttcttttctttcttcttcctctttctttctttctttgtttttcgctctctctctttccttccttccttccttcttttcttttcttttttttttatgagacagtgtctcgctctgttgtccagattggagttcagtggcacgatcacagctcactgcaacctctgcctcccaggatcaggtgatcctcacatctcagcctcccaagtagctgggactacgagcgtgtggcaccatgccaggctaatttttatattttttgtagagacagggtctcgccatgttgcccaggctggtctggaattcctgggctcaagctatcctcccaccttggtctcccaaaatgctgagattacaagcataagctacaaaaatact[210 bp omitted]gaggtaggagaattgcctgaacccaggaggcagaggttgcagtgaactgagatcacgccactgcactccagcctgggcaacagagcgagactccgtctcaaaacaacaacaacaacaaaaactgtgcactgctccaatgacataaaagcaataatgtataggggacttcagaaattacaaagggcggccagacacagtgactcatgcctataatcccagcactttgggaggctgaggtgggcagatcatctgaggcctgtgtctactaaaaatacaaaaattagctgggcgtggtggtagacgcctgtaatcctagctattcgggaggctgaggcaggagaattgcttgaacccgagaggtggaggccgcaatgagctgagattgcaccactgcactccagcctggacaacaagagtgaaactccgtctcaaaaaaaaaaaaaaaaaaaaaaaagaaaagaaaagaaaaagaaattgcaaagggctttcaggtagattctcgtttgtcctctgtgataatgctctgggatgtggagcagccgcttgggaggttgggcatctcgcccaaggtcatgtagcacgtaaggggtatctttagctaggtcttctctccagagccacaccctttctactgtgttgcttctaacatgtacctaaaagcaattttatttgcttacagtaaaagaaactacttttcagtcctcctaacgaatatgattatatgtaagcttaaaaaaaaaaggaaatgtgagccagacatgatggctcatgcctgtaatcccagcactttgggaggggcaggtggatcccttgagcccaggagttggagaccagcctgggcacatagtgagacctcatctttacaaaaaaaaaaaaattaccaggtgtggtggggtgcatctatagtcccagctatttgggaggctgagccaggaggattgcttgagcccaggaggttctaagctgccataagccgagatggtgccactgcacgctatcctgggtgataaagtgagacccctgtctcaaaaaataaaaataaataatttttttttttttgaggcaggttctcgctctgtcacccaggctggagtgcagtggtgcgatctcggctcactgcaagctccgcctcccgggttcatgccattctcctgcctcagcctcccaagtagctgggactacaggcacccaccaccacgcccagctaattttttgtattttagtagagtcggtgtttcactgtgttagccaggatggtctcaatctcttgacctcgggatccgcccgcctcagcctcccaaagtgctgggattacaggtgtaagccactgcacccggccaataaaaaaattttaagaggccgggcgtggtggctcatgcctgtaatcccaacactttgggatgccaaggcgggcagatcacgaggtcaggagttcgagaccagcctggtcaatatagtgaaaccctgtttctactaaaaatacaaaaattagccaggagtggtggtggatgcctgtagtcccagctactcaggaggctgaggcaggagaatcgcttgaacccgggaggcggaggttgcagtgagccgagattgggccactgcactccagcctgggagacagagcgagactgtctcaaaaaaaaaaaaatgtaagaaaagaaatgtattcctattattcaaaggggtgagccatgtgaatagggtcaactctttagaaatcagttagttattctagatcagcagtccccaactttttttggcacaagggaccggtttcatggaagatgatttttccatagaccaggggttggagggggatggtttcaggatgattcaagccattacattattgtgcactttatttccattattattattacattgtcatacacaatgaaataattatacaactcactataatgtagaatcagtgggagccctgagcctattttcctgcaactaggcagtcccatctggggctgatgggagacagtgacagatcatcaggtattagattctcataaggagaacctgcatagttaacaatagggtctgaattcctatgataatctaccgccgccactgctctgatgggaggcgaagctcaggcggtaatgctggctcacccactgctcacctcctgctgtgtggctggttcctaacaggccatggactggtatggacccacggaccagggatggggacccctgctctagatcatcttattctttagctttacttctttctaccctgccatggtgggattaatgacatcttagcttgtgaagggcattccatcacaggatgggcaaggcagcagatgttgcgaatttgctgggattgctactttatttgtggctctggcatgaggtttgaaagcaaccagtaactgactttctctaggatttttgttttcaaatttcagctatttgcagtatctctttgtcttaatccggaatccaaaaactggaggtttgttattctgttgctggaacaaagagagaacatcacctgctttgactggtacaatgtatttcatctatgtctccattcctacctcccataaccaccaaggtcacaggactgcctccccatttttacaggacatagaaacaccaaaagcctcagattgtgctgttgtggaaatagccagagttcaggtgaacgctgacaagaaaagaagctaaaaaagattattttttgtatttggagaatgaagagagtttgtaacaatcatattccaaagcttacatctcttctgatgttaaaacagcagaaagctgcaacagaggctgggcgcagtggatcacacctgtaacccagcactttgggaggctgcagcaggcggataacttgaggtcaggagttcgagaccagcctggccaacatagcaaagccccgtctctactaaaaatacagaaaattagctgggcatggtggcaggcacctgtagtaccagttacttgggaggctgaggcag[135 bp omitted]gccagagaactgcccagtagcatcagaccccagcaaggaggctactttgatgggatttactgaattaaatagataacaaggaaatgtatccagtgcatgtgttacttgtcgttgactacatctgaagccctaatgtcagcaaaggggtctgagcatgcaaggagagagtgcactgaatccacagctgctgtgttctccagggaggtttttttgttttgttttgttttgttttgttttgttttgttttttttgagacagagtctctcactccgttatccaggcacaatcacggttgcaggcttgaccagccaggctcaagcaatcgcccccacctcagcctcctgagtacctaggactacaggtgtgcaccaccacatctgggtagttttttatttttgtagagacagggtctccttctgttgctcaagctggtctcgaactcctgggctcaagcaatcctcctgcctcagcctcccaaagtgctgtgattacaggtgtgagccactgcaccttgctccagagaatttttttttttttgacggagtttggctgtgttgctcaaggtggagtgcagtggcataatcttggctcactgcaacctccgcctcccaggttcaagtgattctccagcctcagcctcccgaatagctggaattacaggcgcccactaccacatccagcttattttttttttttgtatttttagtagagacagggtttc[132 bp omitted]atctttaatttcttcttcttcttttttttgagacagagttaagctcttgtcacccaggcctgagtgcagtggtgcgatcttggttcactgcaacctctgcctcctgggttcaagcaattctcctgcctcagcctctcaagtagctgggattacaggcgcccgccaccatgcccagctaatttttgtatttttagtagagatggagtttcaccgtg[133 bp omitted]atttctctcccttctaagcattccatctgctcccttcccccacttttcctccaacagtctcctgagtaggatttatggaaaatatgtttgcgtctttctaagttagaattttatgagtattcccaagaaatcaggagttatgtgtctattttggaagcacaattttaaaaactacagcattcacttaacactttcactgaaagtatagcttcaaaaagtgatatttgcactcttaaaacatttagatgagtgaattagacataaaggaacaattcacatcccagagctccgtaatgtcctgaaaaaggtgctttatatgtcatagacatcattctcaaatgtcaccgagtctttccttggtctgaaggtcgcatttccctggtgtctcttccatgccgtcttgctctcaggtaaaggagcatacttgggttccggtcagagccctcctcctaacctccatttctggccttgatctcattctctacagctgtaaaagtaataaattgaatgatcctatgaacagagagctcctgtagctctgagttttcatggttccaagagcacaaatgaaatcacagcataacctaaattttataggaacgtgacactcacttgactgtatctagcctgtgtgtgtgttttagtattctgggaagacaagaattgcagtgaatgtgcttccaagcaacgataaacaataaaactgggcgcaatatggctgaccatctctatggcaacctctgttgaccctgtgtatgcatgttttactcattttggtgaatcacattttaaaatataaatgatcttatgttgatgatcatgattttgtgaccatcaattatttgtggctgtgataattccgctattgtttctgctctggaatcagaaaagctgtggaggaggttgggggaggacacaccgggagagagatgactcattttaaccttttctggaacaaacaagtgattacttcagaaaaagatgacttcagtatgtacttcctcccaccacccccatgagctgttcatggtgatgtagacatgcctgtctgcgttgaccctgtcctttaagcactgccatcaggctggggcttctgttcttttgtttttgagacagggtctcactctgtcacgcaggctggaggacaggggcacaatcacagctcactgcagccttcatctcccaggcttaaaggatcctcccacctcagcatcctgagtagctgtgactacaagcatgcaccaccttgcccagccaatttttaaattttttgtagagatatggtctcactactttgcgcgggctggtcttgaacccctgggctcaaacaatcttccacctccacctcccaaagtgctagggttacaggctt[134 bp omitted]cccccgcctcccgggttcaagcaattctcctgcctcagcctcctgagtagctgggactacaggtgccctgccaccatgccaggataattttgttttttgtttttgttttgggttttttttttttttttgagatagagtcttgctctgtcacccaggctggagtacagtggcacaatcttggctcactgcaacctcgcctctcgggttcaagagattcttctgcctcaacctcccgagtagctgggaatacaggaacccgccaccatgccaggctaatttttgtatttttagtaaagacagggtttcatcatgttggctaggctggtcttgaactcctgacctcaggtgatctgtccaccttggcctcccaaagtgctgggattacaggcatgagccactgcacccagccaatttttgtatttttaatagaggcagggtttcaccacattggccaggctagtctcaaactcctgacgacaggtgatccacccctctcagcttcccaaagtgctgggattatagatgtgagccaccacacccagctcagcttctttatttaaatgagtctggaggaaattttttggtgagacactgggttgtactatgctcgttggggacaactctttgagggcctcaattgctaacatctcatgatgggagtttaagaactgctaagaagcatcttcatcagccccattaaaccagatggccatgcaaagtctaacatgacaaatctgaggcttcctggggtcacagctaggacactgaattatagattcagaccctggctgggtgttgtggctcacaaatgtaatactaatgacttgggaggccaaggtgggaggtttgcttgaggccggaagttcaagaccagcctgggcaacatagtgagaccctgtctctacaaaaaattaaaaaactagccaggcatggttacatgcacctgtagttccagctacttgggaggctgacgtgggagaattactgcctgagcccaagaagttgaggctgcagtaggccaagtttgcaccactgcactccagcctgggtgacagagctgtctccatggcctggcactggttttcatcctggtattagaaatgcatcagtgctccctggggaaggggccagtttcaccagctcctgccccatgagctgtgaaaatgcacattctaagaaggagccaggcagggcctgagtccctctgtgacccatgggccatgataaaggtgttggaacaatcgtgccaatatggccacaggaagcacgattgttctctccttgcgcattgcaagggctggaggttgaaggtgtgacctgtgctgttgtcccaggagccggggctttctcagaagcccttttcttgtgatgcccaaacaaccacgcagaaaatgctaattgattactcaccaaaacgactgtgaaaaaatgatgctttgagcttcaaagccccatcacagcttttatctaaccaagaaaccctaggccaagcttgtgcacaagctgggccacatgtggcccaggacggctttgaatgaggcccaacacaaattcctacacttccttaaaacattacaagatgcttttgccatttattttttagctcatcagctatcattagtgttagcgtattttatgtgtggcccaagacaattcttcttcttccagtgtggcccagagaggccaaaagattggaaaccctgcctgggcttttccgatttagccctcccacatttcccagagcaggacagtccctcacaccagtctcaaaggccagcagggcttttcctcacagactgagagctatggtcgctaaagtgatcagaagtgatgataacataatcaagactcttccttagggcttgagggttccagcaaacatctctgccatctgtctgcctgctttttctgtcacttctgaaattctggtatcatgcccgtggtcaaagcaactaacttctgtggctactagaactttcttcctgcttttctcactctgcacttcctgctgctgtcaatgaaactcagcttcttattcccaggcactctcagagtgaggatccataggaggctttgattctcaggacagataaccccatctttcctctggttctgacctatttttctgtgtccttgttactgtggtcatacccagagaagtaacattttgtcttgaatttgtaaaaatctctacctttccccacaaagggatttcagcacagtggctattttaacagataccgtgcagcacgtaccacacgttcccttcctgagtccttgaaagtaattttcagcttttgatcggctatattgttcttcccagctacattttgggaagtccagcagaataacttgctactcttttaaaggtcctaatgataaaacgaaacaaaacatcccctttttatcatcacccacaaagccctaatgcgtgcaacaaagattgtgaaacgtccagggaacagtttgtgagacagaaaggatggctttgttgattagcaaaaagctggaacgtggacaccggcaacacaacaggattgggacccgccttcttcaagtgaaacaaagttggaattattttcaattttaatgttaaatggtttttttgtttgtttccaaattatttgaaaagttactaatccaagcgtggtatgagtggtatcattttggtaattagattaatgcactaccagatcctagaatttcccactttaccaaataaaagaatgttctgtggaattctcctagaccaagacaggcttttcccctgagcaatagtgataaagttgtctaaatacatgaactggtggcatttttcaaaaagtaataatgttataatcaagaggtggtgttgctatgttgcccaggctggtcttgaactcccagtctcaagtgatctgccagccttggcctcccaaagtgctgggattacaggcatgagccaccgtgcctgatggtggcattttgtcttcttcacagaaaaagttaaaagatgagttggatgacattgtgaattgtgaacaacatagtgagatcccgtcccttaaaaaaaaaaaacaaaaattagccacgtgtggtggtgtacccctgtagtcccagctactcaggaggctgagatgggaggatcatctgagtctgggaggccaaggctacagagagctgagattgcattgctgcgctcaagcctgggtgacagagtgagaccctgtctcaaaaacaaaacaaaacactgcctattttatttatttatttattttgtagagattaaggggggggtctcactatgctgtccaggccgatctcaaattcctgatgtcaagtgattctcctgccttggcctcccaaaatgctgggattacaggggtctttaaatgctggggattggcatctttaaaatgaacacactgttttagtttaagagactaaagaggtgcatgtgtatggaataaatgagcctggactgaatcttgtcttttaaaaaagttataaaagatgtatgggacaactggggaaaattaaacatggactggatattaagtgatattagggaattattgctaattgtcttaggtgtgtaaacgtaacatgataatgtaagagaatgtacttacttttaggagatgcatgctgaagaatttagaattgaaggagattgctgtctgcaacttactttcaaatggctggaggccgagcacagtggctcatgcctgtaatcccagcactttgggaggcccaggcagcgaatcacctgaggtcaggacttagacaccagcctggccaacatggcgaaatcctgtctctactaaaaatataaaaaattagctgggcattgtggtgggcacctgtaatcccagctactcgtgagactgaggcaggagaattgcttgaacccgggaggcagaggttgcagtaagctgagattgcaccactgcactccagcctgggcaacaagagcgagactcagtctcaaaaaataaaaataaaaataaaaataaaaaataaataaataaatgcaaccttgcaggaaaaagtacagaaaagactgtaagtcatgtacagacacatgactgaaattaaactacataaacatttccttatatctg[141 bp omitted]gaaactccgtctctaccaaaaatacaaaaaaagaaattagccgggcatagtggcgggtgcctgtagtcccagctactcgggaggctgaggcaggaggatggcgtgaacccgggaggcggagcttgcagtgagccaagattgcgccactgcactccagcctgggtgacagaacgagactccatctcaataaaaagaaaaaaaaaaaaagatcctggagccagactgccagggttcaaagtcaagctctgtcacaactagccgactgtgtggccttgggcacgttatttttctttgctggacctcacatgaccccagtgctcagtctggaaatttttgcctgatgacattttaataattattaaatctagatggtggacatatgaacatttattgtactagtctccgtacaaaaccttttttttttttttgagatggagtcttgctctgtcgcccaggctggagtgcagaggcactatctgggctcactgcaagctccacctcccgggttcacgccattctcctgcctcagc[170 bp omitted]caccgtgcccagccatgtgcaaaaccttaagtaagctgggctcagtggctcacgcctgtaatcccaacactttgggaggctgaggtgggtggatcatgaggccaggagttcgagaccagcctgaccaacatagtgaaacccccatctctactaaagatataaaaattagccgagtgtggttgcaggggcctgttatcccagctactctggaggcaggaaattgcttgaacccgggaggcagaggttgcagtgagctgagattgcactctggcctgggcgaaagagtgaaactacctctcaaaaaaaaaaaaaaaaaaaaaaaaagtgtgcagataaccttggttagtgttttagaatatattactttaaaacaatcccaaacttacagaaaagtcacaggtatagtacacataacttttctctctgaaccacttaaagttaaggtgcttagtcacatactttggttgaaaaaaataattgttaacctgatgcctgatcatccctgaatgctgtagtgtgtatttcctacaaatgagaacgttggccaggcgcagtggctcatgcctgtaatcccagcactttggtaggcggaggccggtgggtcacctgaggttaggagttcaagaccagcctgaccaaacatggtgaaaccccatctctactaaaaatacaaaaattagccagatgtggtggcgggcgcctacagtcccagatactcagggggctgaggcaggataatcacttgaacctgggaggcagaag[131 bp omitted]accatctaatctcaaaccccatttaagttttatcagttgtctcaataaggtcctttctagtcaggcatggtggctcgcgtctgtaattctagcacgttaggaagttgaggtgggcagattgcttgagcccaggagttccagaccagctagggcaacatagggagatcctgtctccacaaaaaatacaaaaaccatctgagcctgttggttcgagcctgcagtcacagctactcaggaagctgaggtgggaggatcctttgaacccaggaggtcaaggctgcag[132 bp omitted]aggctg[134 bp omitted]gaatcacctgaacccaggaggcggaggctgcagagagccgagattgcgccactgcacttccagcctgggcaacagagtgagactgtctcaaaaaaaaaaaaaaaaaagaaattctggactttcatgaccttgatacttttgaaggttagaagcctgttattttgtagcctgtccctcagtttgggtttgtctgatgtttccttctggctaggtcaggttctgcatcttcttctttttttttgcattccacaagtatttactgatcttgctgcataccaggccctgggctggggacacagccacgaatgaagcatggtccctgccaccacaaggtcctcttcactcacacacacactgaggactactgttccatcaccctttcagaagcagctgaatggggctatgtaagaactcatggatgagagcagagggtgaccaccaaaaggtcactgaactcccccaagaaaactgttgagtcgcacacatgtccagttttccaggtccaagacatacaacagtactgctttataatagccaccaggggtgaagccaggaagaaccagagggaaacagggttttctcacatgaaggaagagcagcctgcatcacttaatggttggcctgagttaatggaggacctaggcctcttaaaaggcaccaatgagaacccttacttggacccattccccaccatggttgatctctcatcatgctgagcatgtctcttggaaaggggcaactgggagaaaggataggaatgtgctttgggctatgtcagatggcagacagatcccagttcttattctcaggccctggctttgctagagacacctgccgaggccctatgggcacacccatttggacatatattcaggagccagctcagaaactgagagactcaggctgcccaaatcttcagctttgcttcctaggcaggcagcagaagagtttagacaggaaattttctttttatggcataacacaaagggaaagaaagtcactaggggacacacaggaagaaataaggtttctgtttcttcctcaagtatcccaagtgccatggcagcaatggccttctgggtccatacatggagcacgttctagtaggtcagcccagcccaactgcactgaggtgaaggagcaggcagaagacaggagagtgcatgttggcaggaggggcagagggcactcagggattcttagtaagtacaactgactggagtgtttttgggtagaaggaagaactgagttgcagccaggtgaagacagagtgcccccttgccaggagctcatgctgaagcaacacagtcagccccggagaatcttgaatctgtgaatgctgcccagacagaacaggcatgcaggcaacacttggaatgcacagaaaacacatttcggcctctggtggcccaaaccaagtctgagtgggcacagaaaggccaacatcttggctaggagccaccactcaagtgtaggagagtaagttcaggtcataacagccatctacatcaaagtggcctatcctcgcggaggtgtgactggcccggatcatctctgtcagtgcccacatctgctgcacctcagaggataccctgctggggtctgggagaccctcatggaggagtgcaggttgctcacagggcactgggtgggagagccacttggggaagatcatggaggggctctttggtccctgctgatagatctgcagctcctccactgtgaaagacagccacagtggtgatggctgctgcagaatcaggtgtagctccgatattctggccatgtcacacagtatctgttgcttgaacagcgacacatactcctgggctccctcctcactgtgtgggttgggcatcagacagtagtcccacaggcaggtcacccacttggccggtgtgtgtgctgaggtgtgctgacagacaggatgctcaaaaaagctgtgtagtaattctttttatttttttttgagatggagtttcgctctttttgcccaggttggagtgcaatggtgcgatctcggctcactgcaacctccacctcccggcttcaagcaattctcctgcctcagcctcccaagtagctgggattacaggcatgcaccaccaccccggctaattttgtatttttagtagagacggggtttctccatgttggtcaggctgatcttgaactcccaccatcacacctggctaatttttgtgtttttagtagagacaaggtttcaccatgttggccaggctggtctcaaacttttgacctctggtgatccacctgcctcggtctcccagagtgctgagattacaggcgtgagccaccatgcccggccgctgtgtaataattcttaaatgtgatcccctcaaacggagtgacacaggggaaggtgacatcaatgaccagcacactaggccggccttgggaggtccatacgtcccccacctgcagggctacggtgcctttcacatggcaaggcaccaaaacgcgggacatggtgctagcagccgcgattaagtgcaatagctgctccaggccccgacctccagcccttcctgccatcctcaggttctcatcttggataggaagatcatagaggtgatgctgtgtcctcatttcagcctatgaggtggcacaggatttgaatactgatgatattcactttgattccttcgttaagatggtatttgccatgtttctgtactttaaagttattattttcctatttcagttcggagtggggaggtactttgaggctatgtcaatatcccattcctcatcaaactttccatttattcattaatttatttatggcagtatggactcacggttttctaatttattcaataggttatataattcattcctttcattatttattttgattcttttttctttttctttttcttttctttttttttttgagacggagttttgcttttgttgcccaggctggagtgcaatggcacgatctcggctcaccgcaacctctgcctcccggtttcaagcaattctcctgcctcagcctcgtgagtagctgggattacaggcatgtgtcaccatgtcctgctaattttgtatttgtagtagagatggggtttct[138 bp omitted]tagattcacatgcagtggtaacaaaaattataagggaggacccatgcactccactcaattccccaaatggtaacatctggcataaatttagtaccatgtcaaaaccaggatattaacgttggtgcaatccagagtgtattcagatttcaccagttttgtgtgcacttatgtgtgtgagtttaattccattcagttatttcacgtgtaaccactaccacattcaacagagaaggcttccatccccacaaagctctcttgtgctacccctttataaacggaacagacacctaccttctccaccaccctaatccctcgcagcacctaatctctattttcttatttcagggttattgtataaaagaaatcatacaatactcagttttttcagattggctttttcactcagcataatcccgtggaaatccatccaaatcgttgcatgtatcaagggtttgctcctttgtattgctgagcactgttccatagtatggacatatcacagagataaacattcatccctaatgttgaaaaggcatttgggctgtttcactttgtggctattacaaataaagctgctatgaacattcatgtacagggttgtattttttgtgatcctcccacctcagcctctagagtagttgggaccacaagcgcagaacgcaacgcctcgcctcgtcccaccccaagccgccccgcctcgccttgcctcgcctcattctttttttagatggagtcttgctctgttgcccaggctggagtgcagtggtgcgatctcagcttactgcaacctctcccgggttcaagtgattctcctgcctcagcctcccaagtagctgggattacacgcacccaccaccatgcccagctgtttttgtattttagtagcgatggggtttc[133 bp omitted]tctttccatattgcccaggctggtcttgaactcctaggaccaagcgatcctcctgcctcccaaactgctgggattataagcgtgagccagcgcacatggcccatagaatatattttctcttttttttttctttttttgaaacggagtctcgctctgttgcccaggctggagtgctgtggcatgatctcggctcactgcagcctccgcctcccggcttcaagtgattctcctgcctcagcctcctgagtagctgggattgcaggcgcctgccactgcgcctggataatttttgtatttttagtggagaaggggtttcaccatgttggccaggcaggtcttgaactcctgaccttgtgatccacccacctcgatctcccaaagtgctgggattataggcatgagccatcatgcctggccatcaaagccatcctttctgtctcacaaactgttctctggccatttcacaatctttgttgcacgcattagggctttgtgggtgatgatataaaggggatgttttgtttcattttatcattagaacctttaaaagagtagcaagttattctgctggacttcccaaaaatgtagctgggaagaaaaatataaccaatcaaaagctgaaaattactttcgaggactcaggaagggaatgtgtggtacgtgctgcatggtatctgttaaaatagccactgtgctgaaatccctttgtggggaaaggtggagatttttgcaaatgcaagacaaaatgttacttctctgggtatgaccacagtaacaaggacacagaaaaataggtcagaaccaaaggaaagatggggttatctgtcctgagaatcaaagcctcctatggatcctcactctgagagtgcctgggaataagaagctgagtttcatcgacagcagcaggaaatgcagagtgagaaaagcaggaagaaggcagggcacagttgctcacgcctataatcccagcattttgggaggccgaggcaggcagaccacctgaggtcaggagttcgagaccagcctggccaacatggtgaaaccctgtttctactaaaaatacaaaacattagccagggatggtggcacgtgcctgtagtcccagctacttgggagactgaggcaggagaatcgcttgaacccaggaggcggaggttgcagcgagcagagatccgcgccattgcactccagtctgggcgacagagcaagacaccgtctcaaaaaaaaaggaagaagaaagttctagtagccacagaagttagttgctttgaccatgggcatgataccagaatttcaaaagtgacagaaaaagcaggcagacagatggcagaggtgtttgctggaaccctcaagccctgcactccagcctgggtgacagagtgagattatgtctcaaaaaaaaaaaaaaaaaagaatggctttgttgattagcaaaaagctggaatgtggacactggcaacacaacaggattgggaccctctcttttttttatttttgagatggagtcttgctctgtcgtccagactggagtgccgtggcgtgatctcagctcattgcaacctccacctcctgggttcaagtgattctcttgccttagcctcccgagtagctgggattacagacgcctggctgtaatccacatcgcctggctaatttttgtatttttagtagacacaaggtttcactatgctggccaggctggtctcgaacacctgagctcaagtgatccacctgcctcgacctcccaaagtgctggaattacaggtgtgagccaccgtggtggtcataaataacttttttttgagacaggctctctatctcctaggctggagtgtagtaacgcgatcatggctcactgcagcctcaacctcctgggctcaagcaattctcctgccccagcctctcaagtaggactacaggtgcaccccaccatgcctggctgatttttgtattttttgtcgagacggggtttcaccatgttggccaggctggtctcgagctcctgggctcgagccatcctcttgccttggcctcccaaagtgctaggattacaggtgtgagccactgcccctggctggattgcttcattttaaacactataaaataaatatctcaccctcaccggtaaatacacatatctccccctactccgtttttaacactacagggcaacattctgaattgaaatgttccataatattcatttttgtcactcacctgtaatagtgtagacactggccgggcgcggtggctcatgcctgtaatccagcactttgggaggccagggcaggcagatcacctgaggtcaggagttcgagaccagtctgaccaacatggggaaaccccgtctctactaaaatacaaaattagctgggcgtggtggcgcgtgcctgtaatcccagctactcagaaggctgaggcatccctcagaattgcttgaacccaggaggcagaagttgcagtgagctgagatcgtgccattgcactccagcctgggcaacaagagcgaaactccgtcgcaaaaataaaataaaataaaataaaataaaataaaataaaataaaataaaataaaataaaataaaataaaaagaaaagtaaagtgtagacactagattgtagttgtagaattacatcataatggaaatatgttcaggctgagtccttcctttggcatgtttgcattgtgtgaacagtggaatgaatcaatttctgttaccattaccatatgtttttctcatcccgtatggttttctcagtacatagcatcgtgtaagctactctaacactggagttcagagaactggtttgagttccagcttgctaaccaggtggtgctcaaaacacagccatggccacaaaagcccattctctgaagttggtgtgtgatgtataaattcatagcctaattctccttttgacttctcctcaatacactgtttcataaagatggtagctgcccacccttttgtggttcataagtatggtggttcggttttcatgcttatgtgtgagacatgcctctctccaaccttgttacagcacaggcacattacccatctgacatgaggggaaaaaaggttatggttctaaatgccatttttggaaaagaaaaagaaatccggccaggagcagtagcccatgcctgtaattccagcactttgggaggccaaggtgggcagatcacttgaggtcaggagtttgagaccaacctggtcaacatggcgaaatcctgtctctacaaaaaaaaccaaaaaacaaaaattagccatgcatggtggtgggcacctatagtcccagttactcggaactctgaggtgggaggatcgcttgaacctgggaggcggaggttgctgtgggctgagatcgtgccgctgcactccagcctgagtgacagagtggaaccctgtctcaaaaaacaaaacaaaacaaaacaaaacagaaaagaaaagaaatccaaagactgtgatactttcttcataattcccaagttttaacatggagggtatatattaaaatatatttgtatttcatattatatatgttatatatgacacacacataaagcatatgcacatgacaagagataggccagggtagcgtagacttcagtacttcagatacaaccatcacttttgccatatccacgtaccaaatgaacattatttacttaacatgtttctttaaattggtgcacattttatttattatttatttatttatttttatttatttgtatttttgagatggagtctcattctgtcgtccaggctggagcgcagtggcgtgatcttggctcactgcaacctctgcctcccgggttcaagcgattctcctgcctc[135 bp omitted]gtctcccaaagtgctggaattacaagtgtgagccatcgcgcctggcctatttatttttgagacaggatcttactctgtcgcctaggctggagtgcagtggcgtgatctcagcttactgcaacctccacctcccaggttcaagtgattctcctgcct[134 bp omitted]cggcctctcagagtgctgggattacaggtgtgagccatcactcctggcccacattttaaaacataagtaaaactgcatttatttatctctgatggaactaatgggcacagcaggaaacagacggtaccttccccagtttccttcagcctccatggtgtatatcttttttttttttttttttttttttttttttttttttttaaaaggcaggagccaggcaaggtagcttacacctgtaattccaacattttgggaggctgagataggaggatgacttgaggaccggagtttgagaccagcctgcacaatttagtgagtcccctgtctctacaaggaaggtatggtggctctcacctgcagtctcagctacttgggaggctgaggtgggaggatcacttgagcccaggagttcgagcctgcagtgagctatgattgcatcactgcactccagcctggaccagagattgagaccttgtctcttaaaaagagagagagagtctcactgtcatccaggctggagtgcagtggtgcaatcatagctcactgaagcctgaaactcctgggctcaaggaatcctcctgcctcagcctcctgggtagctgggattacaggcatgagccaccgtgcctggcctagtacatcttttgacaacagaggagcagatttcaggcccagagcttctaccaaacagtagtattcagctgaaattcagtaacttttgtttttgtagtgctgaccccagtatagaaaggaaaaaaacaaacaaaaacaaacaaacaaacaaaaaacccaataacttggaaaaatgttttgtgattacacaaacattctcttttaaggacacaaattatgaaataaagttaattttctttaaaaagatataagttaacatgttaaacatcaacatgttgctatcactttaatttaatcaaagtgattcagttactgtaaggatattttctaacagccacattgcaacttagaaaagaaataaaaaagccaggtagagaaggcagatctttctagtattttgcttcttattcgaatattgagactatgtttgttatgtaactcactataagtagtgcaaaaagtgtgattaatgtgtataatcaaaaactgcaaataaaataaacttttggttatcttgttaatatccctctacaaacccagatagacatctgaatatgcaacatgcaagggtggggtgatggcctcagaacagagatcaggagtgagagggtggccagccatagaggcgaaatcattacaaacactggcacagtggcgcgcaggcaagtgatgcccttcacgtgtgagtaccgagagaaagactatcacttgcacgctagtattgcacccccgaaactaccagtgctatagactagcatttgccacattcccagagcaccccagatagtcacatttttagggcatatgttttctttttgttgtgtttttttgtttgcttgtttgttttgagacagtctggctctgttgctcaggctggagtgcagtggtgtgatctcggctcactgcaacctccacttcccaggttcaagtgattttcctgcctccgcctctggagtagctgggactacaggcacgcgccaacatgtagggcatacactttctataagagtgaaaaatttcatctgttggtctgcttcaagattttgcttaatgcaacaatatgctttaacttttctttcttcccttcccttcccttttctttccttccttccttccttcctccttcctttctcccttccatccttcttcctttctccctcccctcccctcccctccccttcccttcccttccctgtctgtctctttctttctttttgagacagaggcttgctctgttgcccaggctggagtgcagtgatgtgatctcgtctcactgcagcctcaacctccctggcttaagtgatcttcccagctcagcctcccaagttgctaagaccacaggcacgtgccaccacacccagctaatttttttttttttttgtacttttcgtagagacaggctttcactatgttgtccaggctggtctcgaactcctggcctcaagcgatctgcccacctcggtctcccaaagtgttgagattacaggctgtcctaacttttcaaaggggaagagaattgcaaactaaagactaagagcatattctttgttgtaggtgtacgtgtttgttcacagccccttacacagcttgtgtaaggagaccaatttttgatggaagaaagggaaactgtcagtctcaactgcacaagtgagatattggataagttactttacagtttggtgtttctgtttcctgacctgtatgacagacacaagactatggacccatttggtttagtttggttttgggcttaactgatctccaaatacccttttttactgtgaaatgtttgtgatctgcaatcttaggttacactgatgcagtaatttctttgcactgcagtttttttctagtaagagtacagttatggtttcttgtcttcctttttagaatatcttaagtaacgccccacatccaagctcccagtgggtttccagtcctaatatggtgcagggttccttagtgctcacgggtattgatatattagggcaatgtgacccaggaagctgctgcgggaaattgtaaagtaaggtgacattagaaagatatttcatcaaaatgccgaagtgtgcgagagcatatcctccctcacatttctgcacatttgtgtcaagtggtcaaacagttcctaagcaacggtgcggaggcggttgctaggctggcttgtcacgtgtccacggattcagccgctaaagaaatggtgagcccaactgcattcagacagtttattgcttaaagagacagtaagaccatcatggtgtcagctccaacatccttagtcccacaggatgacactgaaccagaggggccaggtgacattgaagggccaactcaaaaacgaccacaagcagttttgtaatagacttacacagaagcctgcagctggaaattaagtctgggcaaggtagaaagcccgataccacaccagagccagggaggccgatgagaaactgcctcacggtggctcctcaccaggcttcttgtcttgcccacttcctggaaaaaaatcacaggacgttctgccaagactcaagtcagacttcaggtaagcctttgccttcgcccacgtggagatgtgcaaggtctccatggcatcatggcagacctggtccctacaactgcactgcctggccttttgtgtaaccagctaagaatttgttttcaagaagcacaggccaggtcaggtgcggtggctcacacctgtaatcccagcactttgagaggctgaggtgggtagatcacctgagctcagcagttcgagaccagcctggccaacatggtgaaactccatctctactaaaaatacaaaaaattatccaggcatggtggcggacgcctgtaatcccagctacttgggaggctgaggcaggagaatttcttgaacccaggaggcagaagttgcagtgagccgaaatcgagccacggcactccagcctgggcaacaagaacataactccgtctcaaaacacacacacacacacacacacacacacacacacaccccaaaaatacaaaaatcagcaggcatggtggcacacacctgtagtcccagctactcgggtggctgaggcaggagaatcacttgaacccaggaggcggaggttgcagtgagccgagatggtgcgactgcactccagcctggacgacagagcaagactctgactaaaaaaaaaaaaaaaacacaggccaccctatcagatgccccaattaattgtactgtgacagtggcatggatgaaatcctttctattggcgttaagtgacatcagatgagaataactgtggctatgatcaagtagaatgatcagacccacctggagaacagaccacagtcaggctcctggtcaaagccaagccagctaagtcggtcattaatccaggtgcagcaagaggtgtcggcaactgcacacagccagccctggccaccagcaggaaatccagggcaatatgactgctcctcaccattcatgttggagagcttagtctggtctgtgtgtgcaagcaagtgtaggcctgatgtccttgtaagacgaggtcccctcttggggcatgaactgtagctagagtttaagaccctggattttttttgttttttttttgagggtggggacgggtggtggggtggagtctcactctgtcgcccaggctggagtgtagtcgtgcaatctcggctcactgcagcctctgtctcctgggttccagtgattctcctgcctccgcctcccaaatagctgcaattacaggcacccaccaccaggcccagctaatttttttttttttttgagacggagttttgctcttgttgcccaggctggagtgcaatggtgcaatctcggctcactgcaacctccgcctcctgggttcaagtgattctcctgcctc[214 bp omitted]tcgc[131 bp omitted]cttggtctgtcacccaggctggagtgcagtggtatgatagctcactgcagcctctgtaagaattaaagaaagaggagagaaacatgaagggtggcttgacagtcaacagatttattttaaacctgggagggacttctgacccttctgagttacgtcagaagccgcactctcttacagactaagaatttttaaggatttagggtgggagagtttatcagaggcttggactgcttctgtgtctctttgttgtgcttatctgggagggagagttttgtgtctgttccaatacatcttcctgcagttgcaggcatcccgagtctgcctttagcttccctatcttagtgcacctgaagggaaaggaatgtgcttattaaggcccactgtttcactggggccccttgtatgaaggtgaagtttggcagttacccaagagactttctccctgccttcctctgtgcctgagctgtcttatctgtgttttattgtctgttcttttctggctgcttgtagttagaagagaagtgatttccttgaaatgcgtgaggctagaaagggagctggaaatgaaagtggcggtatttgtccaagatgacggtgctcctgcgctgtcattgcagaccctatagttataaaaggatgagggggcgacgtgttctttctggctacttcctgctgaggtggggtggagagtttcttggtctcggattgactgcaggagtaacaccatctgtaaatgtttttgggtggttgcaaaatggccatgattctgtcagttaaaactttttgaaaaaggttaattaggcagaataaaaacattagtcctaggcatattactaggagaggacccaggaatgggatgactcatgctatgattttgtttttgaaccaagaatttatttggttcttttggtattcccttagctttttagcccttctttttagtttttcagcagcatttcttactaggcctgattggttgagatagaaacaacatttcttacccaatgagaggcagaggccccctttttcaaccattataagatttagtccccatctgttttggaggactactccagccaaggagtctagttggtcatggactcttataaagcttcgggctatatcttctaaagagccctgtagttttgttgaaagagccttaaagtatgttaaggaggtggctaatccgcttgctcccaatcaaagtccagaggttatacctaaggcggccgttaaaggaatgacatggatggcccatctttttctaacatattggacggatgggatgggcaaaggctgattaggaggaactagtctgatggagggaaatagataaactagggtacaggttccggtccagttggtggggagacaaagataggtgttgctgccacacaaaaagaacaagactttgctgtaaacacaggcagaaatatggaaagagaacaagtgaattaaagatggggtgttttttgttggtttgtttttttgtttttttttcctgtggttcattactccagactgacaaagaggaggccagggaggcgcctactgtagtagagatataggaagagttactttttacacatttaatgcggtcggatgttgcgccattaatattgagccatggaaaaaggtgggcattagggaaagcacaggttaggcctggaggcattggttaagggagaggccgtaaaacgagccggttgcagaaatgttcccatttgcttcaagtgacacttggtagttaatttgattagtttggtagtcagaggggtgtttaacaacgatagcggataggcggttgcattggttaagtgttaatgaccctacagggatatttcccttagaggccgaaaagtaaagtgaggcttgttgaaaaaggggagtgtgtttagttataggcccttcaatgggagggccttggggcttaaggcgttgtagggagttgtaataggtttgaaataatttgttagcctgattggccctggaagtgggataatcaccgattagagtgtcaacttttttaaaaagggaaactcctttttggagtttataaattagggttatatttccagttaaaaggtcatgaaggggtgcaggaagggctgagtaagctgaggaagacagtgataaacacatccagcattccaaagcaagggaagagttagctggcagtaagagggactgtgtaaggtttatagagtgttcgagcttgagggcagtgaggagtggttgtactggtgagattgatgtacttagggaatttatattaaaagaagcaagcaaaaagagaaaaaggttatttgggtaggagtaaagtcctggaaagttccttgaagccataggtcccataaaatagtaaggagctgatcaggatgtgcaatgggagcttcataagggtaccactgaaggtctgtagcaaggcagattaggaagcgatgaaagtttggaagagaaagagacataagcggcttatgtggagttttcctttttttcctctgggattcaggtgaggcaaagggaagtgggtcctgtggagacacaagaaaaggctgaaggagttttagattcagttgtttgagcatgtggtgaagggaagtttattggtttttttgtctttctttttgagagaagtataatgaatccagttagggagtccccagagttttgctgccgtaggtgtggtaaggatgatctggtaaggtcccttccatttagacgtgaggggggatttgggggtaggactgggattttttatgagaacccagtcttctggctgtaggaagggattagaggagttggcagcgggttgtggcaggtatttgtcagcatattccaaatgaaatggtggatggtatgcagaagagggcaagcgagaggggttggtagaggtggtgcttgaccctgagatggaacaaaaagggcaagtggtttcccatacatgagtttaaaggggctgagcattaagggtttacatgggagcacctgaatttttagaagggccaaaggtaaaagtgtgacccagtctttatgtgtttggagcgagtacccggtgaggtgttttttgaatgccattcattttttcaacctttcctgaagattgaggtctataggggatgtgtagcttccaggtgatatgtagagcttgtgcaagtgtttgagtaatttgagaaatgaattcaggaccattgtcagattgaaaagaacaaggcacccagaacctgggtttgatttctgttattaatttggaggtgacagtagaagttcgtttgttggttgtgagaaaagcctcaatccatcctgaaaaggtatcgaccagaactaaaagaaatttaaccttttttactgggggcatatgggtaaaattaatttgccaatcctgtcctagaaggagtcccctggccagatgggatgggaaagaagggggtttagtgttggagtggggtgaagctttctggcaaatagagcattgatgggaaatgacttttaactgttcctttatatctggggctatgtgtatatgggaacttaagaaatgttgtagaggggaatggctagtgtggaagaggttgtgaatgtcccataaaagagttgttttttcagggtcaggtaggactaatttgttttttatgaaccagtatgggggtttgaattgtgcccccaccgtgattagttgtttttggtgttttgcataaaaggaggggatatgttgtatgaggggaaataggtattggggaattggatgattggttgaggcttgttttgcccaacagtcagctttacagttttctaaagaaatgtggctgttatttgattgatgtcctttgcaatggataactgcaaagttttctgggagtaaagctgcctttagcaaatgatggattggtttttcacgaattatcggagtttctttagccatgagatagctctactcgctccaaatttgggcattggaatggatgatgttataggcatatttagaatcggtgtatatattaacttgtatgctctctgctagggttaattcttttattagggcaattaattctgcttgctgggaggatgtgcccaaaggcaaaggggcagcctttacgatgcttctaggtgggaaagagtgggtattattatgatattcctcaatgatggcatatcctgcttgaagggaagggttttttgatgtgctgccatctataaaccaatctggggctccctttatgtgagtggaagtaaggtggtgaaacatggtgagcgaactttcaattagattagagcatgagtgttggtcggggtccaaaggtaaaagagtggtgggattgggggtggggaagcatttatgaagagagatagagggttgaaggggaattgaatgtagtagggcttgcaagtgagaggatgaaattgaggtgagcaccttatgactgaacatatcttgtagactgtgagaagaaaatacctgaaggggttcgtagaatgtgagtttttgtgcctcagggatgatcagagaggctgtggccaaaattttcaagcaaaggggtcagcttttataaatgaggtctagttgttttaaaaaatatgccactggttggagagaatctcccataggttgggctaatagtccaagggcctgattataagaactgtgtaaatataggtgaaagggtttcagggggtttggaaggcctaaagcagggacctgtaataaggcacgttttaggtgagagaaagcatgataaaggtctggggtggaaatgagtggttggtcaagatttccttttgtgtgttcataaaggggtttagcaataatggcaaaatttgctgtctataatcagaaatatcccactaatccaaggaaagaaagtaagttcctttttgttttgggaaatgggatttgttgaatgccttgcttttgtgccagcagaatttcttgggtatttggagttatgattagtcctaagtatgaaacttttggggagatcaattgggccttcccttttgatacctggtacctgcattcagccagaaaatttaaaagcttggtggtgtgttgaatgcaatgttctagagaggggctgcaaagaagtaagttgcccatatattgaagcaaaatgctaggctgtagagatagttgggaaagacccaattgaagtacctgattgaaatagtgagggctgtccctaaacccctgagggaggtcagtccatgtgagttgttgggagcggcctgtatcagggttagtccaagtgaaagcaaaaaggttttgagtggagggatagaaaaataaaggcatctttgaggtttaataggtttaatacagagaaatggctagtgttgggaggaattcgtggtaggagggtgagggggtttgggacaacaggataaacaggaacaatagcagagttgatttgttgcaaatcctgaaccagtctataggagccatctggtgttttaattgggagaatcagaggtattgtggggagaatgggtggggattaaaatattggcagtcaaaagtcaggagatgatgggtttgagttcccgcaatccattagagttgagggggtattgtgggaccactatatggcacttaggatccttcagtgaaatttgaattggagaatggtgggtagcaattatgagggagttagtgtttcataccatgggatttacatggctaaggaatttggggtttaagtctatttgatgttgagtgtctgaggaggggttctgttcttgacataataataaataagggtggctttggtgtaaggctgacaaatggatgattccccctaatttgtgtaggatgtcccttcctagtaaaggagtgagaaaatgagggatgaccaagaaagagtgagtgaaggtgacaccctgaaatgagcagtatagaggtggtgttttgtgtgggtttttttgtgtgcccttcatgccaacaacagaaatggatgagtgttttaatgggccttgatattcagttaacaccgaaagactcaccccggtatccaaaagaaaggaaataatcttaccggacaccatcccaattaccctgggttctgtggactcactaggcatgggggtgaaggatcccggtcaccctcagtcttccgttgtcagcgccagcagtgaagagatttcctcctgtgatggtcagggggctttattatgagccgcacccaaacggggagggtgtccctgttgggggcagtccactttccagtgtccccaaagaccacaagttggacacggtctggtgggggaccagtggttaggacaagcctttgcccagtgtccagagttgccacgtcggaaacagactcccagaggggtcgggtagttttcttttgggtcattgggaggcttttgtgtaactgggttttggatagcagaggcaagcatctggctttttaatgagagatgtttgtctttttgaattttttgttcctcatctctgttgttaaagacacagaaggctacatttaggaggtcctgccgggatgtctggggaccctcctctaagttttgtaattttttccagatatctggggcagattgggaaacaaattggaggtggagaaaagtttgaccttctctagattctgggtccaaattggcatattttagcatagcttcagtgaggtgtgataagggcaggattttcttggggctcttgtgtaatttctctaagtttctcataattaactgccttatgggcatttttgtccatacccacaaggagacagctaatcatgtggtctcttcatctgatgccattgtctccctgttggtaagtccaatctgagtctctacgggggactgcatcattagccactggattttgtataggggcttgattatagagttcatctgtgtggacttcagctgaatgctagatgagctctttttcatcaggagtgagggtggaggttagaattatataaaagtcatgccaagttaaattaaaggattgagttatgtgcaggaatttcctgtgataacgagacggattttcagagaaagatcccagatgctgttcaatttgcgacagattagacatggagaaaagaacatgaacgcaagtaatgcctttaactccagccacttcccggagagggagaatggcagaggtggtttgactggctggagtagtttttgaacgggttacaggtggagaaggaggaggggcagggttaggggctgctggggcggagggttcggacaggcgaggagcgggtgcagggggttgagaacatggagggggttcatttgcagggtcaaaaagagtttcagaggaaggggttccaggggaaggagagacctggggagagttttcattaagaagaaggatttcatgagggatgcaagcttgacatagggagggtcgggatctaaggtagaaaaaagcctgaatatagagaatcgtttgccatttgccattactggttataaagttgtcaaggtccctgagaatttgaaagttaaaggtagcatttttgggccatcgtctgttgttatctaatctgtattggggccaagccatgttgcagtggaaaattaaatgttttggctttagggtcccccgtaagccaagtttggtgaggttgtgaaggagacagcccagtggggaggacgtaggaatgtgggattgtttggcacccatgtggactggtaagaggaagctgagggtgtctgttttgttctaggcgtccccagacaaaagacagagacccagaatcttctttccaaaagaggatggttaagctaagaagaaactgggcatccctaagatttcctctagcttagtcctgttggtcctctggggacctggatggcaggtactgggagaaagccaggagaaggaagaccttaccagtcagctgaattagtgtcccatgttagatgttccagttggaatcagcaaagggcctcccagactgaaggcacacaaggaagagagagagaaagagagagagagaagaaggaggaagaaggagcaagggttagggagcgaaatacctgttacaggcggtcagaggtgaattcctgagacctgagtgttttgaaagctcaccagggagtagtcccagcctgagccttgcagtccccttcaggtcagttgtcctcctcatgcaaatcgctcgaaaattgaagtgaaagaaaagactgggcgggtggccagagaccctcaggatctggaagttaactcaggatgcgctgccattgcccattggttcctgggttgcaagagagtctttcctcccaacacccgtcccgggtttcagcatcaaatgtaagaattaaagaaagaggagagaaacacggagggtagcttgacagtcaacaggtttattttaaacctgggagggacttctggcagagttagttcagaagctgcactctcttactttaagggttcagggcgggagagtttatcagaggcttggactgcttctgtgtctctttgttgtgcttatctgggagggagagttttgtgtctgttcacatacatcttcctgcagctgcaggcataccccccctcccgagtctgcctttagcttccctatcttagtgcacctgaagggaaaggaatgtgcttattaaggcccactgttttactggggccccattgtatgggggtgaagtttgacagttacccaagagactttctccctgccttcctctgtgcctgagctgtcttatctgtgttttactgtctattcttttctggctgcttgtagttagaagagaagtgatttccttgaaatgcatgaagctggaaaggcagctggaatttaaagtggcagtgtttgtctgagatgatggtgctcctgctctatcagcctcgaccccctgggcttaagcagtcttcccaccttagcctcccaaatagctgagactacaggcatgcccagctagttttgttattattaatattattattaacttttattttatgctcaggggtacaagtgcaggtttcttatataggtaaactcatgtcatgggggtttggtgtacagattagttcatcacccagaggcctagtacttaatagttactttttctgatcttcgctctcctcccaccctccacccttaagtaggcctcagtgtctattgctcccttctttgtgtacatgagttctcatcatttagctcccacttataagtgagaacatgtagtattaggtttgctgttcctatttattactattatttttttaagagatggcttctccctatgttgtccaggctggtcttgaactcctgggctcaagtgatcctcctgccttggcctcccaaagtgctgtgattgcaggcatgagccaccatacctggccagaatcatttattaaaacaggaataaatgaattgtgtgtccgttatgggaaacaaactctttgagcagaattaaatagctgcaggccgggcgcagtggctcacgcctataatcccagcactttgggaggccaaggtgggcagatcacttgaggtcaggagttcaagaccagcccagccaacatggagaaaccctgtctccactaaaaacacaaaaattagctgggtgtggtggcgcatgcctgtaatcctagctactcaggaggctgaggcaggagaattgcttgagcccaggaggcagaggttacagtgaggcaagattgcaccactgcactccagcctgggcaacagagtgagactccatctcaaatagaaataaaaataaaaattaaaaattaaaaagtaaacagctgcaaagcaggctggagtgcttctgaagaggacaatgaggctatcactatgaccttaatatttgcatcctcctgacccccaaaaattcatctgttgaaatcctaatcacaaggtaatggaattaggaagtgtggccttttagaaggtgattgagtgattagggactagtgcccttatgaaacaggcccaaggaagcttgttggccccttccatcatatgtggacacagtgagaaggtgccatctgtgaacaagaaagcaggtcctcaccagacactgaatctgctgatgccttggtcttggacttcccagcctccagaaccatgagaaatgcatttctgttgtttacaagccacctactttgtggcagttggttacagtagcccaaacagacttagacagcccttagagtcagcagggccccactgctatggcctcctcagagtgcactggattttgctaataggtttgtagccacctccacagcagcattttttttgatttgaagtctaggacaaggttaccaaagcattctgagatgacaggtcaggccaggagagaactgtaagcaagagcccaagagagacaaaaatggttccagctctacacctctcctaggccactcgcaaaatccagaacccagtttccatgaggtgggcatggaagagacaaaggtagagtggaaagaattccttgtgtggtttgggtctcttacggccagtctgggcctcttcctcttccctttgactgcataattaaacattttatccaaatgggaaatgctttttggacaattgccacatttagagactatattgcctgttttagatatatactttactaggagctaaaccttggtgatccagttatcttttttttttttttttttgagacagggtcttgctctgttgcttaggctggagtgcagtggcacaatcatggctcactgcagccttgacctccaggattcaagtgatcctgcctcctcagcctcctgagtagctgggaccacaggtatgtgccaccacgtccagctaattaatttttcttttcttttctttctttcttttttttttttttagatggagtattgctgtgttgcccaggctggagtgcagtggcacaatctcggctcactgcaagctctgcctcctgggttcatgccattctcctgcctc[224 bp omitted]gttgcccagggtggtctcaaactcctgagctcaagtgatcctcctgcctcagtctcccaaagtgctgggattacaagtgggagccaccactcactgcctttttaactgttaatttagaaataatgatacattctgttgaagttggaaaaaaaaagtacagaggttctgtgaataatttatgcaatttttgataactatagtataatatcaaaaggaggaaattgatactggtacaatccaccaatttaactcaaatttcttcagttttataagcactcatttgtgtgtgtgtgtgtgtgtgtgtactgctatgcaattgcaccacatacatacacacacacaaatcattcgttacacaaatcacatgcgtagattcatataacgaccactaccatcaagattcagaatcattccctcagcacaaagagctgctgctagcctttcataggcccttctccccatccctgtctccttgacaaccactaatcttttctccatttctgtaattgtgttatttcaagaatggtacataaatggaatcacacagtataaaacctttgagattggctttttttccactcagcataattcctttgagatccaactaagctgttgcatttatcatacggaggtaccactgtttatttaaccattcactcactgaacaacatctgggctaattccagtttttggctgttatggataaagctgctaaagccattcattgtacaggtttctgtgtgaatgtaaatgttcatttttctgggctagatgcccaggaatgtaatatcgggtcatatggtagtttcatgtttagttttataagaaactgtcaaaatattttctgccagtctgtagcttgtcttttcattctcttcaaagagtctctctgagggcaaaaatttttggttttgatgaagctcaattaatcacattttcattttatagattatgattttgcgttatgtatgacacttcgtcaggcctgaggtcatgaggattttttaggctgggggtggtgactcacacctgaaatctcaacactttggggggtccgaggcgaaaggatgacttgagctcaggagtttgagaccagcctgggcaacatagtaagaccctgtctctataaaaagtaccaaaaaaatgagctgcgcatggtgatgcatgtacacctgtagtcccagctactggggagactggggtgggaggatcgcctgagccagggaggttgaggttgcagtgagccaagattgtgccactgcactccagcctgggtgacagagcaaggtcctgtttcaaaaataaataaaaaaaataaaataataaaaaataatagtgtactctacagcaaaggtttctgatcagcttgtgacagactattagtgttgtcactttcctatgttactcttatctctaaagcaaaacctattcttaaactaagaatgctttttcttcttaaagtactaggacatttccataagttctgggtctttattcagttagttaacattattaccttgttccctcaaccatgaacatcttgtgaccaagagtgcccaaccctcggggaatgtaacccagcaggtttggctttttctggcctttattttttttgcgacagagtctcgcttcgtcatccaggctggagtgcagtggtgcaatcacagctcacttacagccttgatcttctcctgggctcaagcaatcctcctacatcagcctcctgactagttgggactataggtgcacaccatcacgtctgactaatttttgtatttttggtagagagagggtttcaccatgttgcccaggctgatcttgaattcctggcctcaagccatctcccaccttgacctcccaaagtgctgggattacaggcatgagccactgcactccactcctttttaccgtgttgtcttccaatccatgaacatgatatgtctctctatttatttggatctcctctgatttctttcatttatattttgtaatttttttttttttttgagaaggagtttcactctgtcacccaggctggagtgcaatggcgcaatctctgctcactgcaacctctgcctcccaggttcaaacgattctcctgcctcagcctcccgagtagctgggattacaggcgtgcgccaccatgcctggctaatttttgtattttttagtagagacggggtttc[143 bp omitted]ttgttagctgtatacctaagtattttatcttctctagagcaattatgtatggtattgtgtttcaaattttggtgataatatatagaaatgctaatcattttttttattccaataaaactttatttacaaaagcagcagtccaccaaggtcaggagttcgagatcagcctggccaacatggtgaaacctgtctcgactgaaaatacaaaaaattagctgggcatggtggcggatgcctgtaatcccagctattcgggaggctgaggcaggagaatcacttgaacccaggaggcagagttgcagtgagccgagatcgcgccattgcactccagcctgttccacaagagtgaaactccgtctcaaaacaaaaacaaaaacaaaaacaaaaacagtggtccatatttggtcacaggtcattgattgctgggccctactctaagagaacataaaaataacttggccgggcacggtggctcatgcttgtaatcccagcacattgggaggctgaggcaggcgggtcacctgaggtcaggagttcaagaccagcccagccaacatggcgaaaccctatctctacgaaaaatacaaaacttagctgggtgtggtggtgggtgcctgtaattccagctactcaggaggctgaggcaggaaaatcgcttgaacctgggaggcagaggttgcagtgagctgagatcacgccattgcacttcagcctgtgcaacaagagcaaaactccatctcaaataagtaagtaaatagataaataaataaataaaacttaaagcagatatactcagggtttcttctcacaggcagagttccattatttctaaataagcaaaaaatgacaattatcttttccatttaaaaaattttcttttctttctttttttttttttttttttgagacagaattttgctctgttgcccaggctagagggcagtggtgcgatttcagctcactgcaacctctgcctcccgggttcaagcatactcctgcctcagcctcccgagtagctgaaattacaagtgcatgccaccacacctggctaattttttggatttttagtagagacagggtttcatcatgttagccaggctggtcttgaactcctgacctcaagcgatccacctgcctcggcttcccaaagtgctgggatgacaggcataagccaccacacctggcccatttttagaaatttctaacgtatgactgtcagaaatatcatgattagtccaggtgtgatgtctcaaacctgcaatcccagcactttgggaggccgaggtgggaggatcacttgaggtcaagagttcaagaccagcctggccaagagtttgaaaccagacttggcaacatagtgagaccctgtctctacaaaaataaaaaatgaaagaaaaaatagccagtcatcatggcacacacctgtagtaccagctacttgggaggctgagcggggaggattgcttgagcccaggagttcaaggctgcagtgagctgcgacctactgtactccaacctgggtgacagaatcagactgtctctaaaaaaaaaaaaaaaaaagctgtgggccgggcgcggcggctcacgcctgtaatcccagcactgtgggaggctgaggcgggtggatcatgaggtcaagaaatcaagaccatcttggccaacatggtgaaaccccgtctctactaaaaaatacaaaaattagctgggcgtggtggcatgcacctgtagtcccagctacttgggaggctaaggcaggagaatcccttgaacctgggaggcagaggttgcagtgagccgagattgtgccactgcactccagcctggtgacagagcaagactccgtctacaaaataaaaaataaaaaagctgggcacagtggctcatgcctgtaatccctggactttgggaggctgaggcaggtagatcacctgcagtcaggagttcaagaccagcctggccaacatgatgaaaccctgtctctactaaaaatacaaaaaaaattagccaggtgtggtagcaggtgcctgtaattccagctactcaggaggttgaggcaggagaatcacttgaacccgggagccgagatctcgccactgcactccagcctgggtgacaagaggggaactccttcgaagaagaagaaggagaagaagaagaagaagaagaagaagaagaaagaggagaaggagaggaggaggaggaggaggaggaggaaaaaggggaaggggaagaagaagaaacaatatggttaattttaggccagagtcacatagctagcacatatctccatgactaaaccatatcaattctaaatcccttttatatatctcctcatcaaatgaaaataatctctttgatgctttttcccctggataaaacctttagatggaagatcacacatggccagaaattcaagtgtgggggccataggctgctggctctctaaaggttcgctgaaaatcactgacacgaggtgaatggattaacaggagaaaaggcatccagatgtatttaacatgtgtacacaggagcctccttaaatatcacttcgagattacagacataatggggttttagattctggtcacccagattatgggagggggagaagaggcttggctggcaaaggtggccttgttatgcagacgaagcctcctccctcagagagaattgatggtgaaggtgtttttttttttgtttgtttgtttgtttgttttttctttttgaaacagtctgttgcccaggctggagtgcagtggtgcgatcttggctcattgcaacctccgcctcccgggttcaagcaattctcctgcctcagcctcccaagtagctgagattacaggtacttgccaccatgccaggctaatttttgtatctttagtagagacatggtttcgccacgttggc[135 bp omitted]tggatccagggaaaggcagagaaagggagggggcatggatacattcatgaagattctctacagatgcacattttccccacttcagacagctctgcaaggctgctgctgtcaggatggccaagcggcagccatttcaaaatatgtcaaagaaatgtattctggggtaaaatattttcatttctttcataagcaacctgttggcctttgttatatacacagcaagtttgttgtcaagcccttttgtatcttcatatgttgtgtatcaaatctttttttttttttttttgagacagtttcactctggtgtccaggctggagtgcagtggtgtgatctcggctcactgtaacctctgcctcctaggttcaagtgattctcctacctcagcctcccgagtagctgggattacaggcatgtgccaccacgcccagctaattttgtatttttaatagaaacggggtttcaccatgctggctaggctggtctctaagtcctgacctcaggtgatccgcccacctcagcctcccaaagtgctgggattacaagcctgagccaccgcgcccagcccatatgtatcaattctgacatttacctttcttccccttgtgaaaggaaactaaaaacgcaggaccccaattcactctgccaaaaggaaaaaattaagctgaaagctgagtcatgcaactagctgtctttccttttgttcctaagccaatagctacagataaaaggttaaatatctgtaggggtagctactctgtgctcccttatcttatgtaaagtgatttactgagtgcaagatgaatacataattgactcttcctctacctgctcctttcctcttgcaacatgtggatgacccataccctcctccctctttcccctccgcccccttttccactttaaatatcgaagccttcaaaatcatctttggagaaaggcacagatgtgtctcgtgggcattgtccttaaccttggcaagtaaacttttttttttttttctttttgagacggactcttgctccgtcgcccaggccagagtgcagtggcacgatctcgggtcactgcaacctccccctcccaggttcaagcgattctcatgccagcagatggctagggagtaagactcgagaaatgacatggtgctgagccctgtgggttttcttacgtatccaagaccaggtgctggagaaaccagcaacccagaacaccaagcggtgcagacaaaaaagacccaggaaagcctggcaggcacggtggtgcgcacttgtagtcccagctatccaggaggctgaggcgtgaggttcgattgagcctaggagttcaaatcctacatgggcaacatagtgagacccccatctctaaacaaacaaagacccagagacccagggaaacctctttcccttagccaaaggaccaggtaaggaaggggaagcctcgtaagagagtgtaaaccaaaaagtatctcagacaggtctcaatcaatttcgaagcttactttgccaaggttggaaaaaaaaatcatgtacatttaaagtaactagtaatttgtgtttttaatttttttattgagacagagtcttgctctgttgtccaggctggagtgcagtggagcaacctcagctcactgcaacctctgcctcctgggttcaagtgattctcctgcctcagcctcccgagtagctgggactacaggcatgctcaccaaactcggctaatttttgtatttttagtagagacagggtctccccacgttggccaggctggtctggaactcctgacctcagatgatccaccctcctcagcctcccacagtgctgggattacaggcgtgagccactgcgcctggccaaaagtatcccagagaggtctcaatcaattttgaagtttactttgccaaggttggccaggcatgatggttcatgcctgtaatctcagcactttgggaggccgaggcgggcagatcacctaaggtcaggagctcaagaccagcctggccaacatggtgaaaccccctctctactaaaaatacaaaattagccaggtgaggtggtgcacacatgtaatcccagcgactgaaggctgaggcggaggttgcagtgagccgacattgcgccactgcactgcagcctgggtgacagaacgagattgcatctcaaaacaacaaacaaacaaaaaaagtgcatgttaagtaattagtaatatgtttaggcttgtatctgccatttaattttatttttattgtaaattggcaaattataattgtatgtgtctatggggttcaaagtgatgttaggatatatgtatacaatgtggaatgattaaatcaatctaattaatatattcatcacttcaaatacttgtcattttttgtgatgagaaatttgaaatttactgttagcaattttaaaatatataatatgctatcattaattatagtaatcatactatgcaaaagctgtcaaaaaactttatcctgtctaactgaaactttgtatcctttgaccgacatctccctattcccctcaccctcagccactggtaactacgattctattctctgcttctatgaatttgattgttttagatttcatacataaatgagaacatgtggtatttgtctttctgtgtctggcttattttacttagcataatgtcctgcaggttcatccatgttagtgcaaatgacagaatttccttccttttaaaggctgaatagtgttccattgtgtgtatttaccacattttctttatccattcatgtgttgatgacacaggttgattccttatcttggctattatgaataatgatatcatgaacataagagtgcagatatcattttaacgtattgatttcaaatcctttggatgtatacccagaagtgggatttttaatttttaaggaacctccatacaattttccgtaacggttgtacaagtttacattcttcacaacagtgtgtaagggttccctgttctccacattctcaccaacatttgttatctttcatcttttttaaaattgtattttatggtctgggtgcggtggctcacacctgtaatcccagcactttgggaggctgaggtggggggatcacgaggtcaggagtttgagaccagcatgaccaacatggtgaaaccctgtctctactaaaaatacaaaaattagccaggcgtggtggtgcgcgcctgtaatccagctactcgggaggctgaggcaggagaattgcttgaacccaggaggcagaggttgtggtgagctgagatcccaccactgcactccagctggggcaacagagcaagactctgtctcaaaaaaaaaaaaaaaagaaaaaaaaagaagttgtaggggtctcactgtgttgcccaggctggcctagaactcttgggctcaagcaatcctcccatctcagcttccctagtagctgatactaaaggcatccactgttgtgcccaacttcgtcttttggataatagccattctggcaggtgtgaggagatatctcattgtggtttaaatttgtatattttattatttttttctgtttgttccctctgattctcatttctttgtttctctccctttgccttccttggggtgggtacatgaccattgtttttagaattccattttgacttatttatataatttttgggcatatcactgctatgatttgaatgtttgtgtcccttccaaaaattcatgtctaaacttgatccccaatgcagcagtgttgggaggtggggtcttttgggatgtgtttaggtcaagaggactctgcccttatgaacagattaatactgttagaaaagggcttcatggagggaatacctccctttttgccctttcccctttttttgccatgtgaggacacagtgttcccccactccagaggatgcagcattcaaggcacaatcttagaagcagagagcagcccttcccagatgccaaacctgctagtgactggatcttggacttctcagcctccagaactgtgagaaataaagttttgtgttttataaattatccaatctcaggtattctgttacagcagcacagaatgtactacgacaatcactttgtatggtcttcttagtgattgctctaggtattacaacttgcacgtgtaacttatcacagtccaccgatgtcagtgttttaccactgtaattgacgtggaggaatttacttccctttagatccctttacctatcctattttcaaaatgtaattgtcctaagtgttctctctatatacattgaaaaccgtatcaaatgttgttacaatgttttgcttcaaccatcaaatatggttttaaaacctcatgagagaaaaaaaagctcatgaggagagtatttactcctgttttaacccattctgttgttctcttttcctttctgaagttccaagccttcatctgttatttcacttctgtttgaagaacttcctgtcacctttctttaatagcagatgtcctagaaacaaatttgctatggactgaattttgtctcccccaaaattcatgtgttgaagacttcaccccctatgtgacagtatttggatgtgggactttggggaagtaattgggtttagatgaggtcatcacgggcccttgtaatgggatgagtacccttataagagacaccagaaagcttgtttcccctacccttctctctcctcccaccatggaaggacacagccaggaggcagccctctgcaagctgctaagagagccctttctgggaaccagatcagccagcatcttgactgagggcttcccagcctcccgaactgtgagaaatgaattcatgttgttcaagccacccagtctatggtatttcgtcatggtagcctgaactgattaacacaggcttgttttagttttccttcgcctgagaatgtctttatttccctctcattcctgaaagagactttccccaatgtaggactctcagttgacagttctttcagtacttgaagaatatcatgccacttcctttcagtttccctagtttcagatgagaacgccactgtcattctaatcagtgtcccctatgcctcatgtgtcatttctctctagctgctttcaagggttttcctttgtttttagcgtttagaggttaaatgatgacatatgggcgtgggttttgtttggtttaccctactggggtttgctcagcttcttcaatccgtaggtttatgtcttttgcccaatttgggaagcttgggccgggtgcagtggctcatgcctgtaaccccagccctttgggaggccgaggtgagtggatcacctgaggtcaagagtttgagaccagcctggtcaacatggtgaaaccacgtctctactgaaaaaaaaaaaaaaattagctgggcgtggtggcacacgcctgtagtcccagctactcaggaggctgaggcaggagaattgtttgagcccacgaggcagaggttgcagtgagctgagatagcaccactgcactctaacctgggcaacaaagggagactctgtctcgagaaaaaaaaattaaaaaaatatatatatatatatgaaactttcagccattatttcttccaatattttttcatcactactctgtttcttgtctacttgtagaagtccagtctagtgatataaatcttagatctttgttattgctctgtaggtctctgagactgtccatctttttttagtgtattttgcccctgttgatgagattggacaatttctactgttctgtctgccaagtcacttctctgtcacgttcatcctgccattgaaccctttgcattagttttaacttttttttttttttgcccaggctggagtgcgatggcgcgatctcggcttaccacaacctctgcctcccaggttcaagtgattctcctgcctcagcctcctgggtagctgggattgcaggcatgcgccaccatgcctggctaattttgtatttttcgtagagacagggtttcttcattttggtcaggctggtctcgaactcccgacctcaggtgatccacccacctcgccctcccaaaatgttgggattacaggcgtgaaccacagcgcctactttttttttttttttttttttaagaatctccctctgtcgcccaggctggagtgcaatggcgcgatcttggctcactgcaacccctgcctcctgggtttgagcaattcttctgactcagcctcctgagtagctgggattacagatgtgtgcaaccacacccggctaatttttgtatttttagtagagaaggggtttcaccaccttggtcaggctggtctcgaactcctgaccatgtgatctgcccgcctaggcctcccaaagtgctgggattacaagcgtgagccaccgcacctgatcagttttaactttcatttataatttttatttctatcatttctatttggttctttttctatatcatctatatggtgagattttccttcttgttttttttttcatttatttatttatttattttttaacagggtctcactctattgaccaggctggagtgcagtggtgcagtcacagctcactgcagcttcaacctactgggctcaattgattctcctagcttagcctctcaagtagctgggaccacaggtgcacaccatcatacctggctactttttgtattttttgtagaggtggggcttcaccatgttgccc[131 bp omitted]aattccttattgaatcatttttatgatgactactctaaaatccttgtcagataattccagcatctgattcatcttgttattggcttctgtttctctgttttgttttttggctttttttttgagactgagtcttgctctatcacccaagctagagtacagtggcatgatcttggctcactgcaacctctgcctcccaggttcaagcgattctcctgtcttagcctcctgagtagttgagattacaggtgcctgccaccacacccggctcatttttgtatttttagtagagacgggggtttcaccatgttggtcaggctggtctcggactcctgacctcaagtgatccacccgcctcggtctcccaaagtgctgggattacaggtgtgagccactgcacctggcctgtttgtttgtttgttttgtttttgtttttgtttttttgagacagagtcttactctgttgcctaggctggagtgcagtggcacaatcatggctcactgcagcctcaacttaacctgggctcaggtgatcctcccagctcagcctcctgagtagatgggactacaggcatgtgccaccacgcctggctaatttttctgtttgtttatttttttttttttgtagagatgaggtttcaccatgttgtccaggctggtcttgaacttcggggctcaagtgatccgcctgccttggcctcccaaaatgctgggattatagctgtgagccaccctgcccagccactattggcttctattgatggtctcctttcatttacattgtgatttctctgggttttgttatgacatctgattttttattgtatcctggacatttcgtctatatgctaggacattcagggtcctatttaaatctctattttagtaggcagtcattctgtttaggtttagcattcaggttccaatgacaattaaaaaaaattcgtagagacaagatcttgctctgttgcccaggctggagtgcagtggtatgatcatagcttgttgcagccttgacttcctgtgttcaagggaccctccttcttcagcctcttgagtagctgggactataggcacgtgccaccatgcctggttaatattttaatttttagtagagacgaggtcttgctatgctgcctgagctggtctgaaactcctgggctcaagtgatcctcccacctcactctcccaaagtgctgggattacaggtgtgagccaccacacccagcctccgatgacaattttgtttacagagaccttacagtgtccttctggtctgtttcatttgcctggttccattagggcgttatctcagtctttattggtgccaggggcagatgttgcttccctggttccatctggtgctgctgggtaggggatggaagatgtggagttgggaggtgggaggacttttttcagcttcgggtgttggtaggccttctgctccatttgccttggtgctggacttaggagtagaaggtcttctccccttcccctgggtctgcatgatgcaaagttttttgttttcgtttttgtttttgttttgagacgggttctcactctgttacccaagctgagtggagtggcacaatcacagctcactgcagcctcaacctcctggggtcaagcaatcctcctgcctcagcctccgagtagctgggactacaggcacgcactactatgcctggctaaatttttattttttgtagagatggggtctcacaattttgcccaggctgcaaagttttaaacagagtttttttgtgtgtgtgtggttgcactgctgcaaatggctcagggcacctcatcagactttcacttagttgatctgtctgtgaatcagatcctgttagcctcaggaatctccatgtatcaaggcaagtgccatatgcaaaatcccagggggcagcatggcatagtggcaacttctttttgccatagcttccagtctgcataattgtcagtccctggcattcaaaaggcccattaggcctgatcggcccaagtgtgatggcactctgtatagcccgttggatttttttattcagagcactgccatctctattaggtttttgtttaatacagtgatcttctccacacccctcctccatcttgtgttattttactgatacctcatggctgggtggaggaagccaggtggactcctgcttgtgttctatcccacagctgctgttttaattgtagcattcctccattgagaacatctcatataatcaggagaaggcagggcatagtggctcatgcctgtaatgccaacactttgggaagctggggtgggagaattgcttgaatccaagagtttgacaccagcctgggcaacatagtgagactatgtttgtacagcaaatacaaaaattaactgggcatgatggtgcacacctgtagtcccagctactcaggaggctgggcaggaggatcgcttgagcctgggaagtcgaggctgcagtgagccatgattgtgcactgcactctcctgggcaacagagtgagaccctgtctcaaaaaaaaacaagaaaaccaggagcagtattacacatctattattacagtacttttattatttatttattttttttggagactgagtcttcctctattgcccaggctagaatgcagtggagcaatcttggctcatggctacctccgcctcccgggttcaagtgattctcctgcctca[136 bp omitted]cagcctcccaaagtgctgggattacaggcttgagccactacgcccagactattacggtacttttagcagcatcagttcaaaccacttgagtgtgtgtccatcaagtaaaacataacacagtttgaacaagtatccttcacagtggcgaatccgtgtgggtctgcggcaacctcaatccttgcctcataagaagaaagaattcaactgaggggcataaagcagaaggagagactgaggcaagttttagagcaggagcaaaagtttattaaaaagctctagagcaggaacaaaaggaagtaaagtgcacttggaagagggcaaagtgggtgactaaagagtcaagtgcatggtttgacctttgacttggggttttatacttcagcatgcttccagggtcttgcgtcccttctcccatgattcttcccttggggtgggctgtccccatgcacagtggcctgccagcacctagaaggggccacatgcacactgtgtttactggagttgtacgcaagctcacttgaggcattcttcccttaccagccgaaaggtcagataccagttaaactccgcctcttagtgcgcatgattgagcccattcgcccaactcctggaatcttatcagaaagctgctgttcaccagcttcaggtgttttctatttattgggagaccacctttccctggtgccaacctcaaccaattaccattttagaaaaacagtttaacaaccgcctgactgtcacctgatggtcgcctgacattcctgggggtgggggtgggggcgctcctgccctgctcgtgtctgcctgactacctactgtaacagtatcaaccatggtgaggcacccctgagaacctgagagggtgtcacaggttcgatgtggtcaatctattaggagcaggtgggggccaatgcctagtgtaatggggactctgtaaccaaaagactaatggactaatggtctggcatccgaatcagaaatgtagagttctctactttgtaacaaacagcatcttttccccattttggcttccagagagctgagtattttgaatccacccctgcagattcgctataagaaactttacttggcaagcaggactctggattttgttggggttgaccagctacccctgctggtggaggcgcgacaacaccttggttcgggctgtgagactaaggcttttttttttttttgagatggagtctcactctgtcaccaaggttggagtgcagtggcgtgatctcagctcactgcaccctccacctctcgggttcgagtgattctcctgtctcagcctcccgagtagctgtgattacaggcacccatcatcatgcctggctaattttttggtacatttagtagaaacggggtttcgtcatgttgaccaggttgttcttgaactcctgacctcaagtgatccacccgcctcatcctcccaaagtgctaggattacaggtgtgagccgctacacccagccgagactaatgcttttgaattgccacccaacggaacatcagctatgtagtgaaagctccagacatcagagggtagaggcacttgcactgagaactcacccactggtgacaaatggtagtagagttttccctatgagtgctttttacatgtagcagtgccctaaaaagagaaagaaagcatgtgtgatcagacctgggcggtggggggggggggcagggttggggggtgtctccccattgcccttaacttggcttgcagagctcctctgtcttctctccaaaaagacattgtgaccttacttggcttcacgttggatgccaatttgtcaagcggccaagcagttgttaagcagcagcacagtaaagttggcttgtcacatttctttagattcagctggtaaggagacaacaaactcatttttatttttatttattttttttcagacacagtctcactctgtcacccaggcatgagttcagtagcacaatcacggctcactgcagcctcgacctcccaggctcaagtgaccctcccacctcagcctcccgagtagctgggactacaggtatgtgccaccacgcctgacaattctatttttattttttgtagagatggggtcttgctatgcttcttcagctggtcttgaatttctggacttaaacattcctcctgcctcagcctcccaaagtgttaaggattacaagtgtgagccaccttgcccagccgcataaggatttattatgttcacacagtaaaagcaaggtcattgtgtcatcccagaggatgacactcaactagatgacacaaaacatgcatggtggctcactttgttgtggatgaccc[138 bp omitted]ccaacatggtgaaaccccgtctctactaaaaatgcaaaaaattagccgggtgtggtggctcatgcctgtagtcccagctgcttgggaggctgagacactagaattgcttgaacccgggaggcagaggttgcagtgaactgagattgtgccgctgcactccagcctgggtgacagagcaagactctgtttcaaaaaaaaaaaaaatggaattgagaattacagtgaaatcttccactgtaccctaaggggcaggcctgctgaggcagaaagtcccctgtgtcatcagaaccagagagacaggctgggtgcagtggctcacacctgtaatcccaacactttgggaggctgaggcaggtagatcgcttgagcccaggagtttttttttttttttttctgagacggaatctttctctgtcacccaggctggagtgcagtggtgtgatcttggctcactgcaacctccacctcccagtttcaagcagtcctcctgcctcaaccccccgagtagctgggattacaggcacccaccaccacacctggctaatttttgtgtttttagtagagacaaggtttca[141 bp omitted]aaccctgtgtctacaaaaaaatacaaaaattaactaggcgtagtggcatgcaccgatagtcccagctactcaggaggccaaggtgggaggattgctttagcccaggaagtcaaggctgcagtgagccgtgatcatgcactccagcctaggtgacagaacaagaccctgtctcaaaaaaaagaaccagggaggcagatgagaaacagctttgtgatagctcttcacaggactgctgtgttccaggcgaagatgccagggcatgccaccaggattcaggtgactgctcccaagctttgactctgtagcctatgcggagaaatgccaggctgccagggcacctggctagagccctccacatacaatttatacaatgagacaggccttatagcttagaatcttatcagtatttatttatttatttatttacttatttatttattttgagacagagtctcgccctgttgcccaggctggagtgcagtggcacgatctcaactcactgcagcctccacctcccgggttcaaacgattcttctgcctcagcctcccgagtagctgggattacagacgcgcaccaccatgcccagctaaattttgtatttttagtagagacaggct[131 bp omitted]gggctgtaaacaaaacaactttccattgccagagaattatatttaaatcaacgttactatccaaatgtctaaatgtcttttaacacatggttacttgtttatttcttctctaatcttctatgcaggataaattcagattcttgtcctcaggagtctggattaaaaatatactttgtattgctggcaatattgtcataaaactaaattttcttatacggatacattaaaaagcacagggagtgctgggcttggtggctcatgcctgtaatcccagcaatttgggaggccaaggcgggcagatctcttgaggccaggagttcgagaccagcctggccaacatggtgaaacctcgtctctactaaaaatacaaaaaaaattaatggggagtggtggcatggacctgtaatcccagatactcaggaggttgaggcgggagaatcgcttgaacctgggaggcagaggttgcagtgatctcagctcacgccactgcactgtactctagcctgggagaccccgtttcaaaaaaaaaaaaaaaaaagaacagacaaaatgaatctacggtgcaacaagtgagggtaggagcaaatgcttgggaaggacacaaagggaggttccgggggtgctggtgatgttctgttccttgacctaagcattgtcactgtggggaatgtgtattcactttggaataattcggtcagttggacccatgggttgtgtatatatttttttcctggcaggtgagtggttacacactccactccttagtggattttggcttccatggctactgtcctgctgctttgtacatttttctgataaaagcttcagtgaaaggttttacaaatcaacagaaagaataaacgatgaagaggaaaatggcctgggaaaaaatgatttcatacagataagcttcccagacgctcttgtttcctgactcccgtccaagcgcggtggccagccatctaggcagccttccttaggctttctctcggcttctgcctttgtctgcagccctcctttcttttcactccaggggctgtttattgatctccttgctgccatgccttctgttcccatggtaacgcaggggctgccccatgctgttatgcacttttctctcctaggctcaaaacaagcattgcagaaacggttctttggaacgtgagtccccctagatactctatggaaagagaaaccggttcatggtcaaaacagttttcagggggcagatatggtggctcatgcctgtaatcccaacactttgggaagtcgaggtgggaggatcgcttgaggctagcagttcaagaccagcctgcgcaacaaagtgagacaccccgcccccactacacacacaatctctaaaaataagtaatgaatgcccttactcttggaatttcccagtagatattagcatcttaaaggctctgcacctgtttaaccaaaattttccctaacttttttgaccctggagagccctcccaccgctttccctttaacatttgctggtgccctgggggactatcttttgtggcaaccattttgggaaatgctgcccttagcccttttatataactatttgatggacagctctatctggatgtcacaaagatacatcaaactcatcttgttcaaaacagatttgatactgtccctgtaatcttcagttcctacatcttatcagtcctccaaccctaggatttactttcttcaaatgtctctcaaccccctgacacatctcatgcttactgcttttttttttttttcaatggggtctccccctattgcccagactggagtgcaatggcaccatcttggcttaccacaacctccacctcccgggttcaagcaactctcttgcctcagcttcccaagtagctgggattacaggcgcctgccaccacgcccagctaatttttgtatttttagtagagatgggatttcaccatgctggccaggctggtctcgaacccccaacctcaggtgatctgctgccttggcctcccaaagtgctgggattacaggcatgagccaccgtgcccagctgctcactgctttttaaaaaaattaatttattgatttttatttttgtagagacaggggtctcactatgttgcctaggctggtcttgaactcctggcttcaagcaatcctcctgcttcagccccccaaagtgctgggattacaaccgggcactaccatgcccagctaatttttgtatttttagtagagacagcatttcaccacgttgcccaggctggtcttgaactcctgggctcaagttatccaccccccactcagcctgccagagtgctgggattacaggtgtgagccaccacgcccaacctatactccaatttaacaagctctgactttgcaaaagaacaccaagatcttggttccagttgtcaagaaaaggtttccctggggtcagggtgtatgggccaggaggtgcgcatgcagcgggcctcatagtacagggaacctggctaagagtgttccctatttttacttcaggccttgattacattttgcacctggacttctgcagtagtatcctaaatatctatctgatccccacttctctcccccttcttaaatgtacacttcacactgcaacgcgactgctggaaatacaccgtgattatgttattcccactagttaaaacttcccattgggccaggcaccatggctcacacctgtaatcccaacacagggaggctgagacgggcggctcacttgtgcttaggagttggacaccagcctagccaacatggcaaaaccccatctctacaaaaaacacaaaaattagccaggtgtggtggtgcgtgcctgtaatcccagctactcaggaggctgagggaggagaatcacttgaacccaggaggaggaggggga[221 bp omitted]tgaaaccctgtctctactaaaaataaaaaaaattagccgggtgtggtggcaggcgcctgtaatcccaactactccggaggctgaggcaggagaattgcttgaacctgggaggcagaggttgtagtgagccaagatcatgccactgcactccagcctgggcaacagagcgagactctgtctcaaaataataataataataataataattttaaaaagaaaagaaaagaaacaaacctcccattggcttcaatgaaaagcttgaattccatcagctctgaagcctctcatgcccaccttctcttcccctgccctgtgtacagatcacagaaggtagcaaatctaatcccaccctccactcactctgcctagaatttctttatcatctttatagattagtagagtcagacctgggttcaaatccctgctttacatcttgctagctatgtgacctcatgcagagtatttcagcactacaggcctaattttcctcaact[152 bp omitted]tgaaaccctgtctctactaaaaatacaaaatttagctgggcatggtggtgcgcatctgtaatcccagctactcgggagactgaggcaggagaatcgcttgaacccgggcggtggaggttgcagtgagctgagatcatgccattggactccagcctgggcgacaagagcaagactccgtcttaaaaaaataaagaaataggccggg[175 bp omitted]gaggcaggagaatggcatgaatccgggaggcagagcttgcagtgagctgagatcacgccactgcactccagcctgggcgatggagcaagactcaaaaaataaaataaaataaaataaaaataaaataaagaaataaatacaaataaagctgtggctgggcacagtgactgatgcctataattctagcactttaggaggctgaggcaagaggattgcttgagccaggacttcaagaccagcctgggcaacatagcaagaccctgtctctctaaaaaatacaaaaattagctgggtgtggtggtgtgtgcctatagtcccagctattcgggaggctgaggtgggaggatcacctgagcctggggagttggaggctgcagtaagctgtgattgcaccactgcactccagcctgggccatagaatgagaccctgtttccaaaaaaaaaaaaaacaaataattttaagactcaacgttttgtatacagtccttattctaactctgaatctaatatttaaccaaaagttacacatctcaagccaggttcacccagaacactgctagagaggatcgaccaccttaaccccacccagcttcaagctttacaaggagacccaagctgcacacgggcctctgcttacgatgctgaagagaaggtatgttgtgagcctgcatgccccttcaccctgagatctgattccctgtcatctccgacatcctgtctttctgctctctttctggtcgcccccctccaacttccctcaagccccatgcccctattacacccagtaacttctcacttcaagcctttgtgtttgctctttcccaggtgcctcggtggcttgctgctccctcctgtctttgctccaatagcacctctgcatggaggcctgccttgaccttcttgccccaagtcagaaagccatcatccagaatttgaaaatgatagcttttcattggtatatctataccgatggatctattgattgacttattgatagatatagtgccctccttaacttgcttttggcctgacctgtctggagtgcagtggcatgatttcagctcactgcagcctccaccttttgggctcaagcgatcctcccacttcagcctcctgagtaggtgggattacaggcatgcaccaccacgcccagctaatttgtgtatttttagaagagacggggttttgccatgttgcccaggctggtctcgaactcctgaactcaagtaatccgcccgcctcagcctcccaaagtgctgggattacaggcatgagccacggcacccggcctcaaggggattcttaatgtaattgttcactttacattatataaaaatgtaaaatgattactttttatataattatatatgtatatctctaaatttatactttcttggtttccctgttgatataaaagctcttttctttattttatttatttatttatttgagacggagtttcgctcttgttgcccaggctggagtgcaatggcgcaatctcagctcactgcaacctccgcctccctggttcaagcgattctcctgccttagcctcccgagtagctgggattacaggcatgcgccaccacacccggctaattttgtgttttttgtagagatgggatttctccatgtt[134 bp omitted]ttaagttaaccatgttcttaaacttggcacaattcccataggctccatctagaaagctgacaatctccttcgggcaagctcactggggatttgcggttgtagaccaggggagtagggggcgatttcaacgaacatagccctcccgacagcggtgctactcgtccttcagcatcctttgccttaacctcaaacaaaatggcggcgcccacactgtagccttcctcgggcgccgccatgttggatgacgtttagcctctccctcccccgagagtcagctccttgttagccacgcccacccctgggcttgcgtgattccccctcccccggatgcactaggcctgaatcccattctcctcaccacacctggccaggcctgggtacgatccagtctccagcacatatgtactctgctgagcattctgtctctgatcgtgacctccaggcctcagcgtgacctgccaaatgttcccatgggagatctgaggcctgcattgctagtgcccccactgtaactaaggggctggcttgttgctaggagtttccttgtagctaaattccagtttaggaacttaagctgtttgattgcaggacaagaccctaaatcccaggcctaagcgtagtgttaatgtcagtccctagactgatcaccaagcccaagcttgcgcccctcaaccgattagacgcccacccaccaaggggaatgcctcatttgagtccactctcagcactcccatcgtcaccccacccccgccagcatggcactcttgaccctgtctgagcctccgtgtggccacctggtcccatttagaggtggagagcaggtggtgagacgcacaagagtttattctgagctccttgcgttggcccctcgcacaccgctcagtagctttgtctcgaggcttcctctgtcctcgcgtagtgagccgcgagcagtggtcggcttctgcagtcggcttgggcggatcatgcaaactgagaggagagacatggtacctgctgggagagcagctgggggccgctgaggagaaagggaaaacaatacaagggacaatgagggtcaggacacaaacatccctacacactctcctcaggctgtccccttcaccttaggacactgtccttccctcctcctccctcccacactgcctcccaggcatccctccctgctcctggggacaagcaggtccctgacatcattaacccttcaggcccacgcacaagtgccaacctgttctggctgcggttcacaggccggccgggaaacagtagctgtagctcttatacaggaacacacacctctcatgcccatccaggaaagaatgggtaagcctctgcctgaatggccaacattcaccaccaccacccaggaccttcagagacatcttgaggcaggaactggcgtcttgggaggtgatgatcatgatcgtacagtccctgagacctgcccactgatatttgtcatccatgagactgttaatgcccactgggggcacggtgggggaggacttggaggttgtcatcagcagcaagaagttacctctagggtattgactcattcgaaacgtggtggctcatgcctgtaatcccagcactttgggaagctgaggcagggggatcagttgaggccaggagttcaagaccagcctgggcaacatggtggaatcccttttctacaaaaagtacaaaaactagccgggtgtggtggtgggcacctgtagtcccagctactcaggaggctgaggcgggagaatcgcttgaacccgggaggcaggagaggcggaggttgcagtgagccgagatcaccccactgctctccagcctgggcaacagagtgagacctcaggtgatccacccgcctcagcctcccaaagtgttgggattacaggcgtgagccaccacacctggccagctcacatttatttcagtatttgatatgagaagtgtttgggggtctttatttagaagtttggtgatattttggtgatcagaaatatgccataggagcttaacccttgttatgtcaattagcctatggaaagattggtttttgttatatgttgtttctctgaaattcaaagtttccaagaacctatggagaatgttaagtgaggacttcctgtataccagatgagttgaagaaaagaaaatttcaagatgtgagtgagaaagcaactagggttttacaatgagatctcatctttgtccaaaaaaaaaaaaaaaaaaaaaaaaaaaaaaaaagccgggcgcggtggctcacgcttgtaatcccagcactttgggaggctgaggcaggcagatcacctgaggttgggagttcgagacccagcctgaccaacatggagaaaccctgtctctactaaaaatacaaaattagccaggcatggtggcacatgcctgtaatcccagctactcaggaggctgaggcaggagaatcacttgaacccgggaggtggaggttgcggtgagctgagatcgcgccattgcactccagtctgggcaacaagaaggaaactccatctcaaaataaataaataaataaatacaacccaaccgggggatgggagagggagagcattaggagatatacctaatgtaaatgacaagttaatgggtgcagcacaccaacatggcacatgtatacatatgtaacaaacctgcacattgtgtacatgtaccctagaagttaaagtacattaaaaatatatatatatatatatatatatatatatatatataaaatacaacccaaccaaaaacagttcacatatgtgttggttgtgtgcccttgagaaatttccttagcttctctgtttgtcaacaccatggagataataacagtatggggtttttgtaaaatatagtgtgtatgtaaagtcctggtccttgctttgtagtaaatgttcaatacatgtcagcaacttatcagaaaaaggcatggaaggacattgccaatcgagaaaaatgataagacaagtctcaatcattttaggtttatttgccaaagctaaggaagtgcgcccatgacacagcctcaggaagtcctaatgacatgtgcccaaggtgattgggacacagcttggttttatacattttagggagacatgagacatcagtcaatatatgtaagaagtacactagtttcatgcagaaagacagggacaactcttgaagctgggagggggcttccaggtcacaggcaggtgagagagaaatggttgcattcttttggtttctgataagcctttccaaaggaggcaatcagaatatgcattaatttcagtgagcagagggatgacttcgaatagaatgagacagatttgccctgagcagttaccagcttgaaggggctgaagatattttcctttcacaacataaaccaggatgcagaagctggttaccaggtggaaggaggaaagaaaacaaaataacattaaaatagatagctgtgaaaaatcattataatagcataaatattatgatccactttggtagaattacgtgtgtgtgtgtagtgctaactgtacagtggtaggatttcaagtcattaataattttttctttttttctttttctttttctttctttttttttttttttttttaatatggagtcttgctctgtcacccaggctggaatgcagtggcataatctcagctcactgcatgcaacctctgcctcccaggttcaagtgattctcctgccttagcctcccaagtagctgggattatgggtgcatgccaccacacccggctaattttgtgtttttagtagagatggagattcgccatg[131 bp omitted]ttttttttttgagatagagtctcgctctgtcacccaggctggagtgcaatagtgcgatttcggctcactgtaacctctgcctcccaggttcaagtgattctcctgccttagcctcccaagtagccgggattacaggcgtccgccgccatgcccagctaattttttgtatttttaatagggatggcgttatgccatgatggccaggctggtctcagagtcctgacctcaggtgatctgcctgccttggccttccaaagtgctggaatcacaagcgtgagacaccgcgtccagccccaaaccatttgaaagttagctgcacacagtaatacctttcaattctaaataattctaaataattccctaatattctaaatacttccctaatattgcttaatatccagtccatatttaattttccccagttgtcctatacatcttttttttttttttttttttttttttgagacgaagtctcactttgttgcccaagctggagtgcagtggcgagatctcggctgactgcaaccttcacctctcgggttcaagcggttctcctgcctcagcctcccgagtagctgggactacagacatgtgccaccatgcctggcaaatttttgtatgtttagtagagacagggtttcactatgttgaccaggctggtcttgaactcctgaccttgtgatccgcccccctcggtctcccaaagtgctgggattacaggcatgagccactgcgcccggctcccatacatcttttataacttttttaaaacacaagactaagtccaggctcatttattccatacggttgcacctctttagtctgttaaactaaaacagtgtgttcattttatttttattaattaattatttgttttttcagacggagcctcccttttgtcatccaggttggagtgcagtggcacgatatggctcaatgcaacctctgcctcctgggctcaagcgattctcttgcctcagcctcccaaacagctgggactataggcacccaccaccatgcccggctaatttttgtatttttagtagagagagggtttcgccatgttggccaggttggtctcgaactcctgacctcaggagatccacctgccttggcctcccaaagtgctgggattataggcagtgtgttcattttaaatatgccgacccccagcacttaaagacgcctgtaatcccagcattttaggaggctaaggcaggagaatcacttgagttcaggagtttgagatcagcctggacagcatagtgagacccccttcaatctctacaaaaataaaaataaaaatattaggcaggcatggtggcagtgttttgttttgttttgttttgttttgtttttgagacaaggtttcactctgtcacccaggcttgagtgcagcaatgcaatctcagctctctgtagccttggcctcccagactcagatgatcctcccatctcagcctcctggcagatcacttgagactgggagttcaagaccagcctgggcaacatagcaacaccacctcttgattataacattattactttttgaaaaatgccaccagttcatgtatttagacaactttatcactattgctcaggggaaaagcctgtcttggtctaggagaattccacagaacatacttttatttggtaaagtgggaaattctaggatctggtagtgcattaatctagttaccaaaatgataccactcataccacgcttggattagtaacttttcaaataatttggaaacaaacaaaaaaaccgtttaacattaaaattgaaaataattccaactttgtttcacttgaagaaggcgggtcccaatcctgttgtgttgccagtgtccacgttccagctttttgctaatcaacaaagccatcctttctgtctcacaaactgttccctggacgtttcacaatctttgttgcacgcattagggctttgtgggtgatgataaaaaggggatgttttgtttcgttttatcattaggacctttaaaagagtagcaagttattctgctggacttcccaaaatgtagctgggaagaacaatatagccgatcaaaagctgaaaattactttcaaggactcaggaagggaacgtgtggtacgtgctgcatggtatctgttaaaatagccactgtgctgaaatccctttgtggggaaaggtagagatttttacaaattcaagacaaaatgttacttctctgggtatgaccacagtaacaaggacacagaaaaataggtcagaaccagaggaaagatggggttatctgtcctgagaatcaaagcctcctatggatcctcactctgagagtgcctgggaataagaagctgagtttcattgacagcagcaggaagtgcagagtgagaaaagcaggaagaaagttctagtagccacagaagttagttgctttgaccacgggcatgataccagaatttcagaagtgacagaaaaagcaggcagacagatggcagagatgtttgctggaaccctcaagccctaaggaagagtcttgattatgttatcatcacttctgaacactttagtgaccatagctttcagtctgtgaggaaaagccctgctggcctttgagactggtgtgagggactgtcctgctctgggaaatgtgggagggctaaatcggaaaagcccaggcagggtttctctgggccacattggaagaagaattgttttgggccacacgtaaaatgcactaatactaatgatagctgatgagctaaaaaacaaaacaaaaaaaacaaaaaaaaaccacaaaacatctcataatgttttattttaagaaagtgttgggccacattcaaagccgttctgggtcacatacgacctgcaggctgagggttgcacaagcttggcctagggtttcttggtgagatgaaagctgtgatggggctattgaagcctaaagcatcatttttcactgttgttttggagggtaaccaattagcattttctgcgtggttgtttgggcatcacaagaaaagggcttctgagaaagccccggctcctgggacaacagcacaggtcacaccttcaacctccagcccctgcaatgcgcaaggagagaacaatcatgcttcctgtggccatattggcacgattgttccaacacctttatcacgggccatgggtcacggagggtctcgggccctgtctggctccttcttagaatgcacattttcacagctcatggggcaggtgctggtgaaactggccccttccccagggagcactgatgcatttctaataccaggatgaaaaccagtgccaggccatggagacaagcgatttctcaaatgctgatgtcttgcagatgtagtggcctgaatctagttttttttttttttgagactgagtttcgctctggagtgcagtggctggagtgcagtggctcgatcttggctcactgcaacctctgcctcccaggttcaagcaattctcttgcctc[134 bp omitted]ctcagcctcccaaagtgctgggattacaggctgaggcactgcgccggccttttttttttttttttttaagagacatggtctggctatgttgcccaggctggggcacagtggtgtgaccttggctcactgcagccttgacctcctgggctcaggcaataattctcccacctcagcctccagagtagctgggactacaggcacatgtcaccatggctggctaattttttaattttttgtagagacagggtctcactatgttacccaggctggtcttgaactccccgcctcaagggattctcccatctaggcctcccaaatcattaggattacagttgtaagccacaacacccagtcatggtctgaatctgtaactcactatcccagttatgaccccaggaagcctcagatttgccatgttagagtctgtgtggccatctggtttcgtggggctgatgaagatgtttcttagcagttcttaaattcccatgatgagacattagcaattgaggcccttaaagagttgtctccaacaagcataagacaacccagtgtctcaccaaaaaatttcccccagacttacttaaatacagaaggtggcagggtacagtggctcatgcctgtaatcctagcactttgggaggtcaaggtgtaaggatcccctgttcaagacgagcctgggcaacatagcaagaccccatctctacaaaaaattaaataataataataataataataataataataataataataatggtaattagcctgggctgcagtgagccatgaagtgtggagacttacttgaggctggggtgttgaggctgcaatgggccatgatcatgccactgcatccaggctgggtgacagagggacaccctgtctcaaaataataataataataatctgtacattgtgccactgcacttactcctgcctgggtacactccagcctgagtgacagagcaagactgtctcacagaaaaacaaaagaaaaaatgcacaaaatatgtacagatttttaacaaaatgtgtacagtttttttttttttttttgagacagggtatcactctgtcacccaggctgctgaatggcaaaatcatggctcattgcagccttgacttcccagccttaagtaattctccctacctcagcctcccaagtatctgaaactacaggagtggatcatcgctaatttttgttttgttttgtttttagtagaaactgggttttgccatgatgcccaggttgttctcgaactcctgggctcaagtgatccgtccatccttggcctctcaaaatgctgggattacaggtgtggctaactttttttttttttactttttggtagagatggggtcttgctatgttgcccaggatggtcttgaactcaatcgatgctcccaccttggcctcccaaagtgctgagattactggcatgagccactgtgcccagcccatgtatagaatttttaaaaaatgtattatttattattattttttgtttgtacagaatttttatgataataattgcaaaatgccaatgcaaaaaatcaaaggacaaaatcaatgtagagatataccatgtccaggagttagtaaagtcaatacaataaagatgtcagtcctcctaagaggatctataggcttaatgcaattcctaccaaaatctcagcaaggttttttttgtaggcacaagcaagcttactgtagaattaatatggaaagcaaaagaactagaatggctaacacaatttggaaaagaagaataaaatgagtgggctcactccacttgatgttagggcttactgtatagctatagtaatttgggtggtgtggtattcgtgaaggaataaacatctagatcagtggaatggaatagagagctcagaaaatagatacacacacaaattttattttatttatttttttgtgtgtgtgtgatggagtcttactctgtctcccaggctggagtgcagtggtacaatctcggctcactgcaactgcctcctcttgggttcaagcaatcctcccacctgagtctcccaagtagctgagattacacaagcgtgtgccaccacacccagctaatttttgtacttttagtagagatggggtttcaccatgttggccaggctggtctcgaactcctgacctcagtgatccgctggcctcagcctcccaaaatgctgggattacagacatgagccaccacacccagcctagccaccagatttttgaccaaaggtgtaaaagcaattcaatggaggaaatacagtcttttcaacaaacggagctggagctattggacatccacgggcaaagaaaaaaaaaaaaaccttgggcacactttatagaaaaactacctcaaagtgaatcagagttaaatgcaaaatgtcaacctgcaaacttttagaaaaaaaaatgtagcagaaaatctttggggtcacaagctaggcagacttcttagacttgacaccaaaagcatgatccataaaaaaattggattaactggacatcatcaaaatttgaaacttttggccaggtgtggtgtggctcatgtctgtaattgtagcacactgggaggcccaggaagaactgcttgagaccaggagtttgagagcagcctgagcaacatagtgagaccccgtttctacaaaacaaagaaacaaacaaaaactaaaaaacttttgctctgctgaggaccccattaagaggatgaaaaacatctgcaaactacataccctatgaatgactaggattttgaatatataaataactttcaaaattcaatagtaaacaaaaaatccaatgaaaaaatctctacaagagatgaacagacaattcccaaaaggatatacagatgaaaaatattcacatgaaaatatattttaagggctgtgtgtgctggctcacccttataatcccagcactttgggaggccaaggtgggagtatcacttgatcctaggagttcgaggccagtgtaggcaatatggcgagatgctgtctctattaaaaaaaaaaaaagaaagaaaattagccagacatggtgttgtgcgcctgtggtcccagctactctggaggctgaggtgggaggatcacaaaaaatacaaccctgtacatgaatgttcatagcagctttatttgtaatagccacaaagtgaaacagcccaaatgccttttcaacaatagggatgaatgtttatctctgtgatatgtccatactatggaacagtgctcagcaatacaaaggagcaaacccttgatacatgcaacgatttggatggatttccacgagattatgctgagtgaaaaagccaatctgaaaaaattgcatattgtatgatttcttttatacaataaccctgaaataagaaaatagagattaggtgctgcgagggattagggtggtggagaaggtaggtgtctgttccatttataaaggggtagcacaagagagctttgtggggatggaagccttctctgtcttgaatgtggtagtggttacatgtgaaataactgaatggaattaaactcacacacataagtgcacacaaaactggtgaaatctgaatacgctctggattgcagcaatgttaatatcctggttttgacatggtactatagttatgccggatgttaccatttggggaattgagtgaagagtgcatgggtcctccctagataatttttgttaccactgcatgtgaatttatcataataataataacattattattattattattattattattttgaaacaaggtctcgctctgtcgcccaggcaggagtacagtggcatgatctgggctcactgcaacctccccttcctgggttcaagtgattcgtgtgcctcagcctcccaagtagctgggattacaggggtgtaccaccacaaccgactaagttttgtatttttagtagagacagggtttccccatgttgccc[131 bp omitted]gcccaggctggagtgcagttgcacaatcacagctcactgcagccttgacctcttgggttcaagcggtcctcccacctcagcctcctgagtagcggggactgcaggctcacaccaacaggctcagctagtttttatatattttgtagagccagggactccctatgttgcccaagctggtctggaactcctgggctcaagcaatctgtccacctcagccacctaaagtgctagaatgacaggcatgagccactgtgcccgactagaaaggatattattgagacaagtggtaaaacttgaatggagtttgaggattagatggtagcaacatattacatcatttcctgattttgatggctgtattttggttatataagagcacgttctcatttgtaggaaatacacattaaagcattcagggctgatgaggcatcaggttagcaacttaatttttttttttttttttttgagatggagtcttgcaccgttgcctgggctggagggcaatgacacgatcttggctcactgcaacctctgcctcccgggttcaagtgattttcctgcctcagcctaccgagtagctgggattacaggcgcccgccaccacgcccagctaattttttgttatttttagtagagatggggtttcactatattggccaggctggtcttgaactcctgacctcgtgatccacccccccaccacccttggcctcccaaagtgctggcattacaggcgtgagccaccatgcatggcctttaatttttttttttttctaacccaagtatgtgaccaagcactttaattttaagtagttcaaaaagaaaagttatgtgtactatacctgtgacttttctgtaagcttgggattttttcaaagcaatatattgtttaaaacatcaaccaaggttatctgcacaatttttttttttttttttgagacagagtttcattcttgttgcccaggctggagtgcaatggcacgatctcggctcattgcaacctctgcttcctgggttcaagcaattttcctgcctcagcctcccgagtagctgggattacaggcgcgtaccaccacaccggactaatttttgtatttttagtagagatggggttttgccgtgttggccaggctgatcttgaactcctgacctcaggtgatccacctaccttggcctcccaaagtgctgggattacaggaatgagccactgcgccaggcctgtttttttgtttttgctttttgttttgctttgtttttgagacaggatctcgctctgttgcccaggctggagtgcagtagcgctatctcagctcactgcagcttctgcctcctgggttcaagcgattctcgtgtctcagcctccccagcagctggtactacaggcgtgtgccacctcgcctgcctaagttttgtatttttggtagagactgggtttcaccatgttgcctaggctggtctcgaactcttgaccttaagtgatcctcccaccttggtctctcaaagtgctgggattacaagcatgagccaccacacctggcactttttatttttttaaactaaaaaagaaaggctaggcttgatggctcaagcctgtaatcccagtactttgagaggctgaggtgggaggattgcttgaggccaacagtttgagaccagctatgccacttcatacgcttgctatattgatagcaagaccctgtctctacaaaaactttaaaaattagctgggcgtggtggtgcatgcctgtagtcctagctactgaggagggtgaggtgggaggaaggcctgagactgggaggtagaggctgcagtgagctataatccagccactgcacttcagcctaggcaactgagtgagactctgtctgtaatttaaaaacaaaaacaaacaaaaactacctagtggaatctgtaagatacagctaaattgaaacaagaaaaatcattgcctcaaaaacttaccttaacaagaaaaaagtgatgatgaatgaattgactatccaattcaagaaggaagaggggacggggcgcgatggctcacgcctgtaatcccagcactttggcaggccg[133 bp omitted]tgaggcaggggaatcacttcaaacccaggaagtggagtttgtagtgagccgagatcgagccactgcactccagcctaggcgacaaagtgagactccttgtcgaaaaaaaaaaaaagaagcagaaggaataaatagataaaagaagagattaaattataaaattgaaaaagcaatagcccaaatatataatttcaaataattttcctttggacaataaatatggataagtcattagtgaattaatttgaacaaatacagatagtaaggagtacaagagaagggccagatgcagtggctcatgcctgtaccttgggaggccaaggcgggcggatcacctgaggtcgggagaaaaaaaaaggtgttaatacagtaggaatagtagttgaattgtacttattattattattattgctttttgtttgtttgtttttgagacagagtctcccactgtcacccgggctggaatgcaatggtgcaatctcggttcactgcaacctccgcctcctgggttcaagcaattctcctgcctcagcctcccgagtagttgggattacaggtgcacaccaccacacccagctaattttttgtatttttagtagaggcagggtttcacta[139 bp omitted]tgtctccaggctggagagcagtggtgcaatgatggttcactgtggcctcaacatcctgggttcaagcgatcctcccacctcagcctggtgagcagctgggactacaggtgcttgacaccaagcccagctaattttaaaaattttttcgaagaggctgggtgcagtggctcatgcctgtaatctcagcactttgagaggccaaggtgggtggatcacttgaggccaggagttcaagaccagccctgccaacatggcaaaacctgtctctactaaaagtacaaaaaatgaaaaaaaaaattagctggccatggtggtgtgcctgtggttccagctacatgggaggctgaaacatggaatcgcttgaacccaggagggggaggttgcagtgagctgagattgtgccactgcactccagcctgggcgacaaagtgagactacgtctaaaaaaaaaaaaaaaaaaaaaggccaggcgctgtggctcactcctgtaatccctgtactttgggaggccgaggagggtggatcacctgagatcaggagttcgagaccaacctggccaacatgatgaaactccatctctactaaaaatacaaaaaattagctgagtgtgtgtggtggcaggtgcctgtaatcccagctactcaggaggctgaggcaggagaattgcttgaacccgggaggcagaggttgcagtgagccgagatcgtgccactgcacttcagcctgggcaacaagagtaatacttcgtctcaaaaaaaataaaaattaaaaaattttaaaaatggttctcctgaggcaggagaattgcttgaacccgggaggcagaagttgcagtgagctgagattacatcactgcattgcagcctgggcgacagagcgagaccctgtctcacctaaataaataaaggaaaagaaaagaaagccatatctcaacatatcatttgtaatataacgcaggaaaataattcaggaaataagcttttcaaaacacggaactgacacacccactcactcaccccagtcgcccatcattcctcaccccgcagactctctattagtgaccccatagatagacacaacttggctttcccctgcccctatacctgagcgaagtcgtcattcctgacacaagccagtgtctaggtgattcgctgtccaaagaccccttctgccttacatctggccccgtctctcactcctggcttatataattgctgcctttcgcatcctccttagcagctgtgaagtctcagtttgtccacagccaatatggccttggtggccttgagggtcttgctccttcgggtgcttgggggctgtccgtctgtccgcagtgacgcctcccaaggcgcagcttctccagcaagtggggctcaggtgtgggggcagtgcaggtggcagccaggggtggggtgaggtggggttgggcgtggagttgggcatggagttgggtagacagaggttggagtgttggaactgtgtctcacaatgtgacgtctggagaactcaaagacataaaactctaaaaacacataaagtcaattatagagatataaaaagtctatacacatacgtgatatatgttggattttaagatcattttcataaaaattattgaaacttgtaacagttacaagccagttcgttatactttttattacctttggttcatgtgctttaagtttccataataagaactttttaaaaggctgaagtgcaatggtgtgatctcagcttactgcaacctctgcctcctgggttcaagcaattctcctgcctcagcctcccaagtagctgggattacaggcatgcaccaccatgcctggctaattttattttattttatttttttagacagagtctcactctgtcacccgggctggagtgcagtggcgcgatctcggctcactgcaacctctgcctcccgggttcaagcgattctcctgcttc[135 bp omitted]acctcccaaagtgctgggattacaggcttgaaccactgcgcccagccctatttttgtatttttagtagagacggagtttcaccatgttggtcaggctggtctcgaactcctggccctcaggtgatccacctgcctcagcctcccaaagtgctgagattacaggtgtgagccactgcgcctggcccttcttatttacttttgagatagggtcccattgtgtcacccaggctggagtgtagtggcgcaatttccgctcattacagcgttcacctccccagctcaagcaatcctcccacctcagcctcctgagtaccagctcaactagtttttgtattttttgtagagacagggttctccctatattgtccaggctggtctggaactcctgggctcaagcaacctgcccacctcagcctcccaaagtggtgggattacaagtatgaaccactgcctggttacatgtagtattgaccttatatccttctgcatctgtgattgcatttccttatatatatgtatgtgtagtgtgtgtgtgtgtgtgtatgtggtgtgtgtgtgtatcctactcatgtattgctgtataacagattacccctcaccatgttggcagagggtgtgcttctgttgtaccaaatggaaaccacctgagatggcacccatcacctagaagccacccaccgacaaagccacgctaacactgaggtaccagaaataaggaaagtccttatgactctgagagacctgaagggggtttgtggggtgagtggtggggtctgtttggtaagtaatgatatagtctatgaatacaatgatggggaagtctgtggcctgagtgctgggggttctggcatcctgtaggctgagtgatggactctgtggggttaggtatgcagcgttggggcagtgagtgacaggagtggctccatcatggcttactgcatccttgacctcctgggctcaagcaatcctcccacctcagcctcctgagtagctgggaccacaggcacgtgccacgatgcctggctaattttttagtttttttgtagaggcggggtttcacgtgctgcccaggctggtcttgaactcctgggctcaagtgatctgcctgcttcaacctcccaaagtgctgggattacaggcatgacccacctcgcctggccaattttcatttctctaggataaatgcccaagaatgcaactgctacattgtatgtttaattttataagaaacttaccaaaccattttccagggcggttgtacctttctgcattagcactagcaatctaagaatgatcaagtttctccatatcctagacaccatttggtgtcactatattttatttcaggtgctccagtatatgtatactgatatctcattgtagtcaaaatttgtatttcactaatggccagtgatgttgaacatcttttcatgtacttatttgccacctgtataccctctttagtgaaatatctcttcatgtcttttggccattttccaattggattatttgtttttatccgactgagttttgagagttccttaaatattctggaaagtggtcctttgtgagatatatagtttgccaatacagtttgttcaggtaaatgataggcattttaaaatttgtatgtctatatctgtgattagatctatgcaatatatctcacaaagtatatatctcaaaacacgtttatgagcctaatgggttttatagcattatttccttattatctttgtaatggctttgtaagatgtatagtttgccaatattttctcccggtctgtaacttgtcttttcaccttccatcttcacatgagattttatagaataaaagttttacatttttgatgagggacagttgatcaagttttcctttaatagatcatgcttttggtgtcaagtttaagaactctgggccgggcgcagtggctcatgcctgtaatcccagcactttgggaagctgaggcgggtggatcatgaggtcaagagatcaagaccatcctggccaacatggtgaaacaccgtctctaataaaaatagaaaaaattagctgggcgtggtggcgcgtgtctgtagtcccagctactcgggaggctgaggcaggagaatggcttgaacccaggaggcggtggttgcagcgagccgagatcgtgccactgcactccagcctggcgacagagcaagactccgtctcaaa[136 bp omitted]acctcgtctctattaaaaatacaaaaattagctgggcggggtgttgtacgcctgtagtcccagctactcgggaggctgaggcaggagaatcgcttgaacctgggaggcggaggttgcagtgagccaagattgcaccactgcactccagcctgggtgacaatagcaaaactccatctcaaaacaaaaaccaagaactctgcccatctcaaaattccaaaaaattttttcctatgcctttttcctacaagttttatagttttacattttgcactaactttcgtgtaagatgtgactgagtttgaggctcagtttttccctatggatctccacttgctccagcaccagttgttgaaaagtctatccttctccattatattgcttttgtaaccatacttgtgtggggcttcttctgggttttctattctgtttcattgatttatgtgccaattcctccaccaataccgcactgtcatgattaatgtggctatatcgtaagctttaatactgaatagaatgattccttctactttgttcttctatctcaaaattgccttagctattctagttcctttgtcattccgtattaatttgaaacaattattgtctatgtctgtgaaaaatctttgttgggattttgataggaattgcattaaacttaggtaccaattttggggaaaatgggcatttttttttgagatggggtctcactctgtcacctgggttggagtgtagtggggcaatctcgattcactgcctccacctcccaggctcaagtaatcatcccacctcagcctctgagtagctgggactacaggcatgtgccaccatgcctagctaatttttttttttttggtagagatggggttttgccat[138 bp omitted]tgaacacagcatgcctctccatttatttagtctttttttattttatcaggatttcgtaatttcatcatatagatcctgtgtaagttttgttaggtgtacacccacatatttccttttcttaggactaattgtaagttgtattgtattttaaatgtcagtttctatatgtttattgttagtatacagtgtgattgttttgcttgttgatctttttttttttagagatggggtctccctctgttacccaggctggagtacagtgacacagtcatagcttactgcaactttgaactcctgggctcaagggaccctcccacgtagctgggacgacagatgcatgccaccatccttggccaactctgtttcagtaaagatggggtcttgctatgttgcccaggctggtctcaaactcctggcctcaagcaagcctcctgccttagcctctggaatagccaggattacaggtgcaagccaccacacccagctctttcttgtttttgcttgttgatcttgtattcagcaatctcactgagctccctgatgaattctagtcggctttttttttttctgtagatttcttgggatattttacatagataatcatatcatttacaaatagggacagttttatttttccctttacaattggtatgcttgtattaccttccttgtgttatggtgactagaacttttagtactatgttgaataagaatggtgagagaaggccgggtgtgatggctcatgcctgtaatcccagcactttgggaggccaaggaggaggatcacttgagtccaggagttggagaccagcctgggcaatatggtgaaaccctgtccctacaaaaaacacaaaaatcagctgggcatggtggcacacacctgtggccccagctacttgggaaggctgaggtgggaggatcgcttgagcttgagaggtcaagactgcagtgaactataatctcgccactgcattccagcctaggtgacagagtgagaccctgtcaaaaaataataataataataaataataataaaaataaaaaataaaaaaaagaagaaaagaaaaagaatggtgagagaagacatttttgctccctatcttagggggaataattcagtctttcaccaataatgtgatgttagctgtaggttttttgtagatgctctttatcaagttgagggcattctcctctatttctaacttgctgagacttttttttttttttttttttgagatggagtctcgctctgtcacccagactggagtgcagtggctcaatctcagctcactgcaacctccgcctcctgggtttgagcaattctcctgtctc[135 bp omitted]ggccttacaaagtgctgggattacaggcatgagccactgcgcccagctgctgagactattttttaaaaaacaagaatttgtgttggattttttcagatgtcttctctacatctactaatgtgattgtataatttttcttcttaggttgttaatatggtggatgatattgattgattgtcaatattgaaccaatatgcaatattaaaccaatattgcatatcttgaattaatctcacttggtcatggtttatagctcttttaatacattgttgtatttggtttgctaatattttgttgaggatttttgtgtctgggttcataaaggatattggtttgcagatttctttctttctttctttctttctttctttctttctttctttctttctttctttctttctttctctctctctctctctctttctttttttctttttttagatgaagtctcgctctatcacccgggctggagtgcagtggcgcgatctcggctcactgcaatgtccacctcccgggtttgaagtgattctcctgcctc[134 bp omitted]cagcctcccaaactaccgggattacaggtgtgagtcaccgctcccggccagatttattgtttaatgttggcattggctgagtgcagtggctcatgcctgtaatcccagcactttgggaggctgaggcaggtggatcacaaggtcaggagcttgagaccagcctgaccaacatggtgaaaccccgtctctgctaaaaatacaaaaattagccgggtgtggtggcaggtacctgtagtcccagttactcggaaggctgaggcaggagaattgcttgaactggggaggcggaggttgcaatgagccaagatcttgccattgcactccagcctgggcgacagagcgcaactccatctcaaaaaaaaaaaaaaagttggcattgcctgtttttgtctcggggtaattctaatgtcataaaaggagttgagaaatgttctcttctgttttctataagtgattacgtaaaagtgctgttaattcttctttaaatgtttggtagaaatctccagtgaaaccatctagatttggagatttcatttctttgagcttttaaattataaattcatttaaatttatttaatggtcattcagattatttacttcatcttagttaagttttggtagtttgggatatctgaggaattggtccattttgtctaagttatcaagtttatgagcagaacgtgttttgtagtattattctcttattatctttgtaatgtcttcagaatcagcaatgataagccctattttatttctgatatttgtgatttgtgtcttttaatatttgtcagtcttcctagaggattataaattttattgaactttttttttttttgagacagagtcttactcagtcgcccaggctggagtgcagtggcgcaatctcggctcactgcaacctccgcctcccaggttcaaatgattcttctgcctc[134 bp omitted]tggcctcccaaagtgctgggattacaggcatgagcgaactttttgaattaccagtttatttatgctttttttttttttatttgagtcagggtctcactttgtcgcccaggctggagtgcagtggcgaaatctggcttgctgcagcctcgacctcccagactcaagtgatcctcccacctcagcctcctgagtagctgggactacaggtgtgcaccaccacacccagctaattttttaatttttctgtagagacagggtcttactatgttgaccaggatggtcaaactcctgacctcaagggatcctcccaccttggcctccaaaagtgctgggattacaggcatgagctcaacctgattgtgttttgaacatcttctataaccttgctgatttatgtctagtagttatataagatggggagcagtgggtattgatgtttccaactataattgtggatataagaatttctccttttagctctatcattttttgcttaatgtattttgaggctctgttgtttagtgcataaataattaggatatttatgatttgctggtggattgattggtacttctatcattatgcaatatttctctttttctctagtaattttcttttctctgaagtctaccttatcaggttttaataaagccacttcattatttttcattaatatttgcatggtatagcttttttttttttttttttcttttttgaggcaaggtcttgctctgttgcccaggctggagtgccgtgatgtgattatggctcactgctgcttcgacctcctgggctcaaatgatcctcccacctcagccacctgagtagctgggaccacaggtatgcaccaccacacccggctaattttttgatttttttgtagagatgaggtctggctatgttatctgggctggtcttgaactcctggacacaagcaatcctcttgcctcagcctcccaaagtgctgagattacaggtatgagccacccagcccggctaaatgtctgtctttgaattggcatgtttagaccatttacatttgaggcagttattgctatgtcaacacttgtgtttttcattttattatttgttttctgtttgttttctttggttcttggtcctttgtttttcttgtcttactgtgggttacttgaatactttttagaattctattttgatttatttaatgttttcgagtgtatcttcttccttgcatagttttcatagtgattgttctgggtattaaaatacgcatgtgtctcttagtctcttgtcacagtctactgtgttttttttttttttttagaaggagttttgctcttgttccccaggctggagtgcaatggagcgatctcggctcatgcaacctccgcctccccgggtttaagtgattctcctgcctcagcctccttagtagctgggattacaggcgcccgccaccacgcccagctaattttttgtatttttagtagagacagggtttcattatgttggccaggctggtctcgaactcctgacctcaggcaatccacccgtctcagcctcccaaaatgcaaggtttacaggcgtgagccaccactcccagctcagtctactgtgtcaataacggtgtctttttttttttttttaaatagtggtaatcttcctgctattaaccgtgtcttttactttctgttttctgatcctttaccatctggagctttgctgactatggaggagctgtcccttccaggcttcaccaattcctagagatagtaggcaacttgtccctgggtgtacctttcaaatgcaaaccagccaatccagagtctgtaaccccaaccatctcttctatggggctgtcacattcttggccactatccctctgtcctaaccatgccaggggcaggcaactagaaactgtctctatgccccatatgctgaaattattcaaacaagctaatcctaaaccttcttaccctgcattgccagagacagagagatggagatgcatgttatggtgtctttttttttttgaaacagagtcttgcactgtcgccccagctggagtgcagtggtgcgatctcagctcgctgcaacctccacctcccgggttcaagcaattctcctgcctcagcctcctgagtagctaggattacaggcatgtgacactacgtctggctgattttttgtatttttagtaga[152 bp omitted]cactctattgccccggctggagtgcagtgacatgatctcagcttactacaacttgtgcctcccaggttcaagcagttctcccgcctcagcctctctagtagggattacaagtgtgtgccaccacgcccagctaattttttgtactttttagtagagacagggtttcaccatgttggccaggctggtcttgaacttctgacctcaagtgatccacctgccttggcctcccaaagtgctgggatcacaggcatgagccgccgtgcctggcctggtgtctctctctctttttttttttttgtggagatggagtttcgttcttgtgcccagactggagtgcaatggcgtgatcttggctcactgccacctctgcctctggggttcaagcgattatcctgcctc[134 bp omitted]ccttccctccccactcttccttcttttttctttccttctttctctttttcccttcctttctttctttctttctctctttctttctttccttccttcctttccttccttccttctctctctctctttcttttttccctccctccctcccttctttccttccttccttccttccttccttccttccttccttccttccttctttcttctttccttctttctaagggtctggctctgtctcccaggctggagtgcagtggcgcaattcccgctcactgcatcctccacctactgggctcaagtgatcctcccacctcagcttcctgagtagctgagactataggtgcatgccaccatgcctggctaatttttgtatttttttttttttttggtagatgtgggggtttcaccatgttgctcaggctggtcttgaactcctgggctcaagcaatttgcccaccttggcatcccaaagtgctgtgattacaggtgtgagccaccgtgaccagccaaactatcttttcaatggcagttatctactgacctgttggccttatggcatctgaataagaaacacctattgtcttcctttgtttaggctgctctctcaaaatatcatagactgggtaatttgtaaacaacagaaatgtactgcttacaattctggaggctgggaaatccaagatcaaggaggcggcagattcagtgtctaatgaggactcattcctcatggatggtgccttctatgtcttctcgcatggcagaaggggacaacaagctccttcaggcctctttcataaggtcacatcactaaatcctacttatgagtgcagagcctttataatctattcacctcctacaggcccaactcttaatactattgctctggagattaagatttactgtatgagttttgtatgaattcagaatatatatatatatatatttgtttgtttcttccttttttgttttttgagacagaatctcactctgtctcccaggctggagtgcagtggtgcaatctcggctcactgctacctccgcctcctgggttcaagcaattctcctgcctcagcctcccaagtagctgggattacaggcatgcaccaccacgcccagctaatttttgtatttttagtagagatggggtttcatcatg[137 bp omitted]ctgtgaaatgtggaaacctcactttcatttaggttctttacctaacccacttttaaatatcattgctttagtatcaaatggtattataatttttgtttcaatcatcaaatatggtatataaaactcatgaggcaaaggagagtctattttatgcactcgtatttctgctcttttcattgagcgtttttccttcctgatgctccaagaatttttcttcttttcctttgtttgtttgtttctttttctttttctttttcttttttttgagacagggtctcactctgttgtccaggctagagtgcagtggtgccattataattctctgtaaccttgaactcctgggcccaggtggtcctcctgcctcagcctctggagttactgagactacaggagtgcaccaccatgcctagctaattttgaatttttttgtagagatgggggtcttgctatgttgctcaagctagtctcaaactcctatcctcaagcaatccttcagcctcagcctcccaaagtgctgggattacaggtgtgagccactgcacctagctgaatctttcttttctcattttctttttcttttcttttcttttttttttttttgaagaacttccttagtcagttgttaagggtaggcctgctagcaacagattattaagttttcctgtctatgtctttatttccctttttacctgacagtttcaccagatatagaatttgtagttgacagctcttttctttccagcactttgaaaaatgttatgctacttcctcctgacctccagatgagaaatctcctgtctttttttttccttttttttcctgctcaggaaaggaagaatgctgacatttaaattgatgttctgctatgagtaatgcttgtttctctctggctgctttcatgttattttcattttctttagctttcaaaagttttttttttgtttgtttgtttttgttttttgagatggcgtttcgttctcattgcctaggctggagtgcagtggcatcatcttggctcaccgcaacctctgcctcccaggttcaagcgattctcctgcctcagcctcccgagtagctgggattacaggcatgcaccaccacacctggataattttgcattttttgtatagacagggtttcaccacattggtcaggctggtcttgaactcccgacctcaggtgatccgcccacctcagcctcccaaagtgctgggattacaggcatgagccaccacgcccggcaaaagttttattataatatatctagacatggacttctttgagtttatcctctttgagattccctctgcttcttggatttgtaggtttgtgtcctttgccaaatttgggacatttcattcattatttcttcaaattctcttttggcctcattgcctttcttttgttgtgggacttccatggtatgaatactgggtgatatggtttggctctgtgtcctcatccaattttcatgtagaattgtaatcctcacatttcagaggaaggacctagtgggaggtgattggatcatgtgggcagattttccccatgctgttctcttgataacgagtgagttctcacaagatctgatggttaaaaagtgtagcacttcccctctttgcgtgctctctctctctcctgccaccatgtaagacgtgccttgcttctccttccccttccaccatgattgaattgtaagtttcctgaggcttccccagtcatttggaactgtgagtcaattacacctcttttctttataaattacctagtctcaggttgttctttacagcagtgtgaaaatgaacaaataaggctgggcgtggtgactcatgcctttaatcccagcactttgggaggccaaggcgggtggatcacctgaggtcaggagtttgacaccagcctgaccaacatggagaaaccatgtctctactaaaaatacaaaattaaaaatacaaaaaaattagccgggcatggtggtgggtgcctgtagtcccagctactcaggaggctgaggcaggagaatggcatgaacctgggaggcagagcttgcagtgagccaagatcacgccactgcactccagcctgggtgaaagagcaagagtcaaaaaataaataaataaataaaaatataaaaaaataaataaaaaataaaaatacaaaattagccaggcatcatggcgcatgcctgtaatcccagctacttgggaggctgaggcaggggaatcacttgaacctgggaggcagaggttgcagtgagccgagatcacgccattgcactccagtctaggcaacaagaacgaaacaccgtctcaaaaaaaaaaaaagaaaagaaagaaaagaaaaagaaaacgaacgaatgcactgggtcttttgttgttgtctcataggttttcgaagctctgttcaatattttctgtcagttttcactcctttattcatattgggtgaattttactgatctgtcttcaaaagttaactgattctatcttctgtcttctccattctactattgagcccatccagtgagattttttttttttttgagacggattttcattcttgttgcccaagctggagtgtaatggtgcagtcttggctcactgcaacctctgcctcccaggttcaagtgattctcctgcctcagcctcccaagtagctggaattacaggcatgttccgccacacctggctagtttttgtatttctagtagagacagggtttcaccatgttggccaggctggtctcgaactcctgacctcaagtaatctgcccagttcggcctgccaaagtgctgggattacaggtgtgagccaccacaccaggccccagtgagatttaaaaaaatttttttttaattttgttgttgttaatagaaatggggtctcaccattttcctcaggctagtctctaacacctgggctccccaccttggcctcccaatgctgggattacaggtgtgagctactgcccccggccgtggtttttatttctgttattgcacttttcagttctatatttccatttttttgtattaataatttctatttatttgctgggatttttctgtttccttatttgttccaagagaatttgtagaatttgtagttgattgctgaaactttttatgatggctgctttaaaacccttgtcagataattccatcatctgagtcatctttaaacaaaaaatttttttttttaatttgcatgtcatccttgcacaggggccatgctaatcttctctgtatcattccagttttagcgtatgtgctgccaaagtgagcacatctgagtcatcttgatgttggcgtgagttggttatcttttcgtattcaagttgtgattttcttggttcttagtataatgtgtaattttctattgtattctggcgatttgtttttaattaaaattttaaaatggccaaaaattgtgtgtgtatatatatatatatatatatatctatagtacaacataatgttttgaaatatatatacactgtggaatggctaaattgagctaattaacatgcattacctcacatatttatcatgtttttgtgagaatacttgaaatctattcccttagtaatttattttatttaattaattaatttatttattttgagacagggtctcactttgttgcacaagctggtgtgcagtggtgcaatctgggttcatctcagccttgacctcccgggctcaggtgatcctcccacttcatcctcctgagtagctgggactacaggcacctgccaccatgcccggctaatttttgtattttttgtggagacagggtttctccatgttgtccaggctggtcttgaagtcttgggctcaagtggtcctcccgcctcggcctcccaaagtgctaggattacaggcgtgagccaccacacccgaccagcaattttcaagaatacaacaccaccaggcacacggtggctcatggctgtaatcccagcacattgggaggccaaagcagaaagatcacttgagcccaggagcttgagaccaggctgggcaacatagcaagaactcatctctacaaataaaaaattagctgggcgtggtggtgcacacttgtgttcccagctactcaggaagctgaggcaggaggatcacttgagcccaggagaccgaggctgtagtgagccgtgattacgccactacactccaaagacacagggagaccctgtatctatttaaaaaaaaaaaaaagagtacagtacattactcttaactatagtcactgtgttgtacaatagatctcacttattcctaactgaaatattgtatccttcaccaacatctctccaacccccttcacccccagcccctagtaaccaccattctactctctgcttctatgagttcaacttttttagattccacacataagtgagaccatgtgatatttgtctttctgtgcctggcttatttccttatcatactgtcctccaggttcattatataatttcctttggttatgtatctagtagggagattgctggatcatatggtaattctatttaaattttttttgtgtgtgtgagataggatattgccctctcccccaggcgggagtgcagtggcacaatcaatcgcagctcactatagcctccacctcttggggtcaagtgatcctcttgcctcagcctcccaagtaactgggattacaggcgtgtgccaccacacccagctaatatttgtattttttgtagagacagggtcttgctatgttgcccaggctggtctctacctcctgggctcaagtgatactccctccttggcctcccaaagtcctgggattacaggtgtcagctactgtgcctggcctatttttaattttttgaggtgcatcctggtctattatgttaggagactcggagtcctatttaagtcttattttagcaggcagtcactctatttaggtttatcatgtaggttttggcctagtttttctgctgtgtttctaatggcggtttagtcttcagagcctttgtggtgttatttttgtctgtttggtctatctggtacctctgaggctcccacttgtctctgctggtgctgcctgacgaagcaggggaaatttctacaggccaggtctccacgtctttctttctttctttctttctttcaggccagatctccacgtctttctctttcttttctttctttctttctttctttctttcaggccagatctccacgtctttctctttcttttctttctttctttccttcttttttctttctttctttctttctttctttctttctttctttctttctttccttcaggccagatctccacgtctttctctttcttttctttctttctttctttctttctttctttctttctttctttctttctttcttttcttttctttctttctcagagtctcactctgtcacctgggatgaaggagagtggcgtgataatggctcactgcaggctcgacctcctgggctcaagtgatcctcctgcctcagcctctcgagtagctgggatcacaggcatgtgatgtcacgcctggctaatttttaatttttggtagaggcaaggtctcctcatgttgcccaggctggtctcgaactcctgggctcaagcaatagtcccgcctcagcctcccaaagtggtaggattacaggagggagccactgcgcccggcctccgggtgtttcttgatgatggggcgatgtgatgaggtccccctacccgtgccttctggctgcccaggtgtctctgcagggaagcagaatcccaggcctgcaaagccagtggggcttcttgggccaggatgcttgttgtagttgggtccccttgctggtgatgcctgtttgccccggtgcctctgagcaggagagggattttctgagtctggtcacctgctgtggttatatcatttctgccagtttcacctactagtcccaggcttcctgttgggagaagggagtctctggtcttcaaggcacctaagttaagggattgtccaggcctggcctcttgctatggctgtgtctttttgatgcagtacaggttgtctctatccgcctgggcagggtggggtcggggggaggtcccttgttggggaggcttatccctggccctgtggagaaggacagcacttttcatgaccacttattgttagtgggttcccgatccaccccctcactgttggtgttgggtttacctcacgttatcagagggacttccctttcatccaggggaggaactagcctatcggggctgccttccatggcttggatcagggtcacgaaatgctgggcttgagttgccttcttctggtgggtggggggacataagatgccctgtagtagtgctgtttctccagtcttggaatcctaaatgagttcactttctttttcttttttttttgagatggagtttcactcttgttgcccaggctggagtgcaatggcacgaccttggcttaccgcaacctccacctcccaggttcaagcgattctcctgcctcagcctcccgagtagctgggattacaggcatgcgccactatttctggctaattttgtatttttagtagagatggggtttctccatgttggtcaggctgatctcaaattcccgaccttaggtgatccgcctgcctcagcctcccaaagtgctggggttacaggggtgagccactgcacctggccaaggagttcagtttcttcttgccgccatgcatagtttccctttggttgtctcttgtactatttccagggttgatagttgtgctcagcaggaaggagcagggagaaataggtctatgttatcttgtccagactggaaatctctattttttaaccaccaatgcctctcaggtctgaccttaaaccctctgttaattattccatcaacaatgcctattctttttttttttttttttttttaagactgagtctcactctgttgcccaggctggagtgcactggcacgatctcggctcactgcaagctccgccttctggattcacgccattctcctgcctcagcctccccagtagctaggactacagaggctcaccaccacgcccggctagttttattttattttattttatttttgtatttttagtagagaaggggtttcactgtgttagccaggatggtcttgatctcctgaccttgtgatctgcccgccttggcctcccaaagtgctgggattacaggcatgagccaccgcacctggccttttttttttttttaagatggagttttgctcttgtcccccaggctggagtgcagtggtatgatctcagctcactgtaacctctgcctctcaggttcaagccattctcctgcctcagcctcctgagtagctgagattacaggcatgcgttaccatgccgagctaatttttgtatttttagtagagatgcagttttaccatgttgcccaggctgatctcaaactcctgacctcaagtgatccacctgcctcagcctccccaagtgctaggat[137 bp omitted]tgcctca[226 bp omitted]tgttggccagggtaatctcaaactcctggcctcaagcaatcctcctgccttggcctctgaaagtgctgggattacgggtgtgagccaccatacccagcccacaatgctactgttgtctgtccttgaatatgggcttctgtcagcaattcacccatctttcatacatctttaactctggcctctattaactcttatcattcatggtcctctggtctacaatacaaaatcatgtctctctcagcttgatgtgatttaggaaaaaccaaaagtacttttcctactccttttttttcttttttttttttgtaacaggttctctctgtcacccaggctggagtgcagtggtgccatcatggctcattgcagcctcaacatcccagctgccagctcaagtgatcctcctacctcagcttcctgagtagctgggactacaggcgctcagctaattttttttttttttgacggagtctcgctctgtcccaggctggagtgcagtggcgcaatctcggctcactgcaacctccaactccctggttcaagggattctcttgcctcagcctcctggtagctgggattacaggcacatgccaccacgcccagctaatttttttttttgagacagtatttcgctttttcgcccaggctgcagtgaaatggcatgatctcggctcactgcaacctccgccccccaagttcaagcgattctcctgcctcagcctcccgagtagctgggattacaggcacgtgccaccgcgcctggctaatttttgtatttttagtagagacggtgtttcaccatattggccaggctggtcctgaactcttgacctcaggtgatccacctgccccggcctcccaaagtgctaggattacaggcgtgagccacca[147 bp omitted]cctgtctctactaaaaatacaaaaaaaattagccgggcgtggtggcgggcacctgtagtcccacctgctggggaggctgaggcaggagaatggcgtgaacctgggaggcagagtt[316 bp omitted]gaggcaggagaatcacttgaacctgggaggcagaggttgcagtgagctgagattgcaccactgcaccccagcctggcgacagggcgagattcca[134 bp omitted]cccatctctactaaaaaaaatacaaagaaattagccgggcgtggtggcgggcgcctgtactcccagctactcgggaggctgaggcaggagaatgatgtgaaccagggaggcggagcttgcagtgagccgagatcttgccactgcactccagcctgggcaacagagcaagagactccatctaaaaataaaaaataacagtaaaaataaagaaatacctgagactgggcaaagaaaagaggtttaattggctcatggttccacaggctatacaggaagcatggtgctggcatctgcccagcttctgaggagggctcaggaaaattacgatcatgacagaaggtgaagaggaagcaggcacgacttaaatggctgcaacaggaagagagagggggaggtgctacatacttttaaataaccagatcttttgataactcactcactcactatcgagagaacagcaccaagaggatgatgttaaaccgctcatgaaggaacacccctatgatccaatcaactcccaccaggctccacctcctactttggggattacaattcaacatgagatttgggagaggacacagatccaaaccatatcagatgggggtctcactacgttgcccaggctggtctcaaactcctggcctcaagtgatcctcctgtttcagcttccaaaagtgctgggattacaggagtcagccactgtgactggtctccttttcctacactccactctcactcagcacttctgataccagatgtgtggaggttccccagtgccccctgccccccagcaaatttctggcacattctccagcaaacaccagttcagtgtcctctaattcaattccattccaacattacctacctggaagtcagatcccctagagttatagtaggcagctagttaggcatgagcagggcaggagaaggctttcctcccacacctaggaccagcaatgtcaggtgaccatcaggtgatggtctcagtatcatgggctcagtatcacaaaacctcccccaacttcagatgccaatggcaagcacaggttgtgacctatgcttcttcttcttctttttttttttttgatggagtctctctctgtttcccagactggagtgcagtggtgctatctcggctcactgcagcctccacctcccaggttcaagcgatcctcctgcctcagcctcctgagtagctggaactacaggcacgagccacctcacctggataatttttgtatttttagtagagatggagtttcactctgttggcctggctggtcttgactcctgaccttaagtaatccatctacctcagcctcccaaagtgctgggattataggtgtgagccaccatgcccggccccaggctagtcttgaattcctgggctcaagcaatcctcccacctcgacctcacaaagtgtttggattacaggcatgagccaccgctgatgcttttggttttttatggaggcttcattacctagacatgatcggttaaaccattggccattggtgatcaagtcaatcttcagccactctcccctcccaggaggttgggggtggggctcaaagtcccaactccctatttagttgctcagcccccaacctgaagctatctagaggcccccagccaccagtcatctcattaacaagcaaaagacactcttatcattctggatattccaagggtttttggagccatttgtccggaaactgggacaaaaccaaatatatatgccacaatatcactcagctccatcaccatcaatggcatgttattgaggctgggtgcggtgcctcacccctgtaatcctggcactttgggaggccaatatgggaggatcacttgagcccaggagtttgagacaagcctgggcaacgtggcaaaactctgtctctacaaaaattagctggggtgtggtgacttgcacctgtagtagcagctactcaggaggctgagatgggaggatcacctgagcctgggaggtcaaggctgcagtgagctgtggtcatgccactgcactccagcctgggtgacagaatgaaaccctgtctcaaaaaaaagtcatgttgtctagaattgtgccatcagataaggccgaaatagccacatggttattgagcacttgaggctaatgaggccaggtacagtggtcatgcctgtaatctcagcattttgggaggctgaagcagaaggattgtttgaacccaggagatcgaggctgcagtgagctatgattgtaccactgccctccagcctgggcgacagagcaacaccttgtttccaacaaaaaacaaaacaaaacaaaacaaaacaaaaaactatgaggctaatcagattgaggaactgaatttctaaatttattcattttagttaatttaacatttaaattagatactcacacacccactatgtacccacaaaagtaaaaaataaaaaaaattaacacacacacaataaaatagataattaaattattggaaaacttttaaagtatatttggaatgacttgtgaatttgttgttgtttgtttatttatttctagagacaggatctttctttgttgcccaggctggagtatggtggcacaatcatagctcactgcagcctggaacctctggccataagccatctcccctcctcagcctcctgagtagctggaaccacaggggagcaccacgatgactagctaattttgtttagtttttgtagagacagggtctcactgtgttgcccaggctagtctggaactgctggccttaagcaatcctccctccttggcctcccaaagtactgggattacaggcataagctactgtgcctggccacttgtgaatatttttgtttttgttttttgagagagtttcgctcttgttgccaggccagagtacaatggcatgatcttggctcaccgcaacctccacctcccggatttaagcgattgtcctgccttaacctcccaggcacatgccaccacacccggctaattttttgtatttttagtagacacggggtttctccatgttggccaggctggtctcaaactcttgacctcaggtgatccacccacctcggccttccaaagtgctgggattccaggcgtgtgccaccacgccaggaatgttaacctatgttttcaactaaattttgtgaaatctaagtacaaatcaagtatttctgatgaaaatttagctttcaaaattgagatgtgctgtcagtgtaaaatacacatctgatttcacagtgttattaccacaaaaagaatgccaaatatctaggtaattttaaaaatttattacctgttgaaataagaatgtttggttaatgtagttcaaacaaagtatgttattaaagttaatttaacttatttcttttcctttttgtgtcatctgtctgcaacctctcatgttacatctcctccctgtcttccacttgggttggaaattgaggctcctgttctgtgtcaaagtgatttagtctctcaggcattaagatgcttcattcttaatgatgtaatttgaaccgcaaaattatttcgcctagtgacaaggatgttcgcatttcattggccatggagactaaagcttgcctcccacacagagccattggctagctgcaccatctctccaaagcaacctcgggctgtgcccccacccacttcaaatacctccagctgtgctatttacctgcaccctccccgtcaggctatgtccgtcctgccccttccttgcactggacaatggggacttctgctgatttacagatcaggcagcctcatattgacctgggagaccagagcctgtttcttatattcagccattagctaactgcgccttctgtccacagcttctcaagctaggctttggctgcctcgcttcacatggcaacggggttagttactacctagtaacagtttaccatgactgccataggctgaagagactaaagcccatcttctcgtgcattcattggctaactatttatagcaactcaggtccctttcaccctgcacatagcaacaggggcttctccctagaacaggctgctacttcatcccattggccaccaggaaccagatcccacctccccgatgcagccactggtcagctgcaccatctgtctacaactccccagatttggtctagacaagaaatctcaaactgctggtttctatgaactctgctgccaccactgctcatctggctggacctcgaacttggtcatttgttatctaatccaccgtcaataactcccttgtcaaaatctaaaatctgggcccctgttaacattttcaccacttctggaccaactttaaaccccatcttttttttttttggtgagacagtctcgctctatcgcccaggctggtgtgcagtggcgcgatctcggctcactgcaacctctgcctcccgggttcaagcgattctcctgtctcagcttcccgagtagctgagattacaggcgtgagccaccacacccagctaatttt[140 bp omitted]taactcttccaccatcactgcctttctgcagcttagcattcagcctttaactattcccccagcaataccccgctgacctgaagcctgaatcaggcctattcatttttccaccgtcaatacatactaggactgatctcaaacttcacctctgtgaactcttccaacattaatgaccttgataaagactaccaaggtcacatccatagtcgcaaaagagatgggtttattaacctgctgcggcaaggaagaccacgccccacaggaactgtggggatgtctcacctaaggtaacttaacttgttccagtttgcccaggactttcctgcttttagtactgaatgcccttgtcccagtaaaccctattcctgggcaaacagagttggttgatcaccttagtgtcaatgaacaaaggaagaaatgggattagtataggatataggagtggagtttaggtaaagtttaaatgaagcagtgttttgacaagcccaaagcaaaggaggttggtatggaaaaggattaacattaggttcagactgtgaagcagacctagggtcctttttctttagaaacacaaaagaagctgggcgcagtggctcacgcctgtaatctcagcactttgggaggctgaggcagttggatcacctgaggttagcagttggagaccagcctggccaacttgatgaaaccctgtctctactaaaaatacaaaaattagctgagtgtggtggcacatgcctgtaatcccagctactcgggaggctgaggcaggagaatcgcatgaacccgggaggcggaggtcacagtgagtggagatcacacactgcactccagcctgggcaacagagcgagactctgtctcaaaaaaacccacaaaagataggctgcgtgcagtggctcaggcctgtaatcctagcacttgaggtgggtgaatcccttgagcccaagagtttaagaccagcctgggcaacacagtaatatcttgtctttacaaaaaatgaacaaaggtagccgggcgttgtggcgtgtgcctgtagtctgtcagctacttgggaggctaaggtgggaggatcacttgagcctaggaggttgaggctgcagtgagctgtgatcatgccactgcacttcagcctgggtgacagagtgagaccctatctcagaaaaaaaagaaaagaaaaaaaaacactaaacatagatgtgaagttttggcttcagatacccattatctgaagctctgcacctgggtcagaaatcaaggctgtttctctgtgtcaaagtaacttagatcctccagggaagagtaggaggttttattcttattgatattatttcaaacaggaaattttccgatagtctatgattttagataacaaggtttctctgcagggctaggactagggtaaggtgagggaggcattcgccttaagtgtaaaatgtaagggggtaccaaaaaaactcagtaatcaagatcaataccatttgactgattgagacagtgtttcgctctgtcccttaggctgcagtgcagtggtgcgatcatggctcactgcagtctggacctcccaggctcaagagatcctcccacctcctcacctcctgagtagctgggactacaggtgcgcgtcaccatgcgcaactaattttgtttattttttgcagagacaaggtatgttgcccaggctggtctcaagtgatctgcccacctcggccttcccccaaattctgggattacaggcgtggactatcgcgcccagccaagatcaataacattttttgtttgtttgagatggagtctcgctctttcacccaggctggagtgcagtgatgtgatctcggctaactgcaacctccacctcccgggttcaagctattctcctgtctcagactcctgagtcactgggactacaggcacgcaccactatgcccgactaatttttgtattttactaatacaagagatggagtttcaccatgttagccaggttggtctcgaactcctgacctcaggtgatccacccactttggcctcccaaagtattgggattacaggtgtgagccatggcgccaggcctcctcccctcccctcccctctcctctcctttcctttcttttttagacagggtatcactctgttgaccaggatggagtgctgtggtgcgatctctgctcacttgcaaccactgcctcctgggttcaagccatcttcccacctcagcatcctgagtagctgagactacagatgcacaccaccacacccgttaagttttgtatttttggtagagaagggttttgccattttgctgaggctggtcctgaactcctgacctcaagcgatcctcctgcaccctcttcccaaagtgttgggattacaggcatgagctgccgcgcctggccgcgcctggctgttttctaagcatttttctttttttaaaataaattgaaatgtggtctcactctgtcacccaggctggagtgcagtggtgcaatcataactcactgcagcctctaactcctgggctgatgcgatcctcccacctcagcctcttgagtagctaggactacaggcgtgtgccaccacacctggctaatttttgtatttttagtagagacgagtttcatcatgttgcccaggctagtctcgaactctggatctcaagtgatccgcccacctcagcctcccaaagtgctgggattagaggtatgaaccaccgcgccaggcctctaagcatttttctattgataatttgctaaaaaaacattagttgcccatggccgggcacggtggctcacgcctataaccccagcactttgggaggctgaggcaggcggatcacctgaggtcgggagttcaagaccagcctgaccaacatggagaaatcccgtctctactaaaaatacaaaattagccgggcgtggcggagcatgcctataatcccagctactcgggaggctgaggcaggagaatcgcttgaacccgggaggcggaggttgtggagagccgagatcgtgccattgcactccagcctgggcaacaagagtgaaactcaaaaaagaaaagaaaaacaaacaaacaaaccattggttgtccatatcaaaggctattattcctaactactatcattgtagtggggcaaggagggtaacggagatggggggaattcaagtcttctccatggtaactgcagcacatcgagagattgtacaccctgactcctttcccctcttctccagtggtatcgcccacgacgggcacctgtgttaacctgattactcctcctcttcccagtggtatcgccaagggggggattgtaccaccctgacttcttccccctcttgcccagtggtgtctcccttgagcatcagaacacgcccccctcctccctgggtaggaggcgcacctctgcttctttaaactttgcccaaacttatagaaccgagttccaaagaccagcttctcccagaatcttgcccttagagggattctacccgtgaacgccctctcgcccccgccttctgtggaacagcccactgtacggaatgggtgctaagatggcggctcccaagagacacgacatagcgcagccatattcctcgcctgacaacgccactcatggaccaagtctccgccgatccgtaacagcgctgtgttcagtgagtagactacaatctctcagtcctaatgatcgtgtgcaaaatcaacagccctagaaggtgcagtgtcaggggtgaggacaggaaacggaaatccccctcagaggccgtttaagtcttcttggcgcgcgatgctaaatgcagtgcacgaggttttatggcgtgatagtcgctcaggtgattttgaggttttgttggcttcgggggatgatgcattggcagttgtggtgtcaattggtggggaaataaagaacctaatgaatgggaatctatgagtgtcagggatgagggcctctggagtagtcaggttttagattccctgctgtgtcttgatgtccagccttaatagtgtgcgctttaggtttttcctttatcagtattcccagaggtttgctaattttattagcctttccaaaaaaacaacttttgaccttgttgctcctctgatcacagatctcttctgatgtaccttcgtttcctatttctttaatttctgctcttatctgtaccgttttctctaacttcttaaattggatgttaattcattaatgctcagcctttctttgttaaaaaaatttttaagagcatgcgtttttccttaagaatctctttagctgcaatcaagaatattttgtatacaccatcttttctttctttctttctttcttttttgacggagtctcgctctgtcgcccagactggagggcagtggcgcgatctccactcactacaacctccgcctccgtttccagcgattctcgtgcctcggcctcccgagtcgctgggattactggcgcacgctaccacgcccagctaatttttatatttttagtggagatggtggtcttgccatg[131 bp omitted]tgtaatcgtataggcccacctccttaaaatgtttattctggctgggcgcggtggcttactcctgtaatcccagcactttggaaggccgaggatggcgatcggttgagtccaggagtcgagaccagcctgggcaacgcagggagaaccccgtctgtacaaaaaaaaaaaaaaagaaagaaagaaagaaagtaagaaaaattagctgggcgtggtggagcgttcctgtagtcccagctactccagaagctgatgtgggaggattgcctgattccgaaagccgtgattgcaccactgcactccagcctgggtgacagagggagaccttgtctcaaaaaaaaaaaaaagttatacttacacttacgtattttatatagtttttgctatcattatttatgcaattttgtttccattgcctcattgttattatagagagaaactatctgcttttggccaggtgcggcggctcatgcctgtaatccctgcgctttgggaggccgaggtcggaggatcacggggtctggagtctgagatcagcctgaccaacatggtgaaaccccatctctactaaaaatacaaatattagctgggtgtggtggtgcatacctgtaattccagctactcaggaggctgaggcagcagaatcgcagaagcgcttgagcccaggcagaggttgcagtgagccgagatcgtgccactgcactccagcctgggcggcagagtgagactccgtctcaaaaaaaaaaaaaaaaaaaaagaaaagaaactatctgcttttgtaattttaccttgtatccagccccttacattatattataccctattaattttagtagtcttttagcagtctggtaggttttccatgtataaaatcatcttattggatagaaagctacattttcgttttcatttcttcccaatgttcatgttcaccctaattattattttcttttttctttctgcctttttttctttttctttttctttttttttttttttgttttgttttgttttgtttttggggtggagtcttgctctgtcacccaggctgaagtgcagtggcgtgatctcggctcactgcagtctctgcctcccgagttcaagcaattttcctgcctcagcctcctgagtagctgggattacaggtgtgtgccaccatgtccagctaatttttgtgtttttagtagacacggggtttcaccatcgtcttgaactcctgacctgctgacctcaggtgatcagcctgccttggcctaccaaagtgctgggattacaggcgtgagccgcctcctctggcctcttttttttttctttaatagaaacaaagtgtcactctgtcatccaggctggagtgtagtggagtgatctcaatgcactgcaactctgtgtgtgtgtttttgtttgtttgtttgttttttaaggatactgggttttgccatgttgtccaggttagttttgaacacctgggctcaagggatcctcttgctttggcctcccaaagtgttgggattaaagccgtgagccactgcacctggcctgattatttatttcttttctcttcttttctcctttcttccctccttccttccttccttccttccatccttccttcctctctttctttctttctttctttctttctttctttctttctttctttctttctttctttctttctctctttctctctttctttttctttctcttttagagacaaagtcttgctctgtcacccaggctggagtgcagtggcgccatcagaggtcactgcagcctcaacctctcaggcttcttaagctatccttctgcttcagcttccttagtagctggcactacaggtgtggaccaccacactcggattattttatttcttgtaaagacagcgtctcactttgttgccaaggctggtttcgaactcctggactcaagcaaccctcctgtcttggcctcccaaagttctgagattacaggcatgagccactgtgcccagcccactctatttcatcttctcttgtgtgagctagagcccacaaaacaattttgggttatagcagacagtactaattttgtggcaatagcttcatcattttactttttagcatggtgtttcagagttatgtttcataattgatttttgtggcacttaagttatttactttttccatgattttagtttgagcttatattagtaatggctgctgaattgcgttggatgcttttttggtgtaagttaacagcagagtgtttccctctgtaatttgttgatgtaatacataacattaggcctggtgcagtggctcacacctgtaatcccagcactttgggaggccaaggcgggaggatcacttgaggtcaggagttcgagaccagcctgaccaacatagtgaaaacccgtctctactaaaaatacaaacattagctgggcgtggtggcgggcgcctgtaatcccagccactagggaggctgaggcaggagaatcccttgaacctgggaggcggaggttgctgtgagctgagatcgcaccattccactgcagcctgggtgacaagagtgaaactccatctcaaaaaaaaaaaaaaaaaaaagaaaaaatacataacattattaagattgaaccatttttttctggaaagaagaggctaaaagcttcccagtaaaagaatttaagagggatatttcatctaagagtggaaaaaaacaaaagacggcagaagaaaggaccagccgatttcctttcatttagattatcagctttccaggtttcctgccctcacagtcacccaccaggtccccttgaacctgcccaccccatgggccttaagcacccttaagcactgccccagttctacttctcctaaacccagatctgccttgaacttgaactgaggtgtaggctggctgagtagcgagtgaagcacctggtagagccactcaagaagggaccccaagctcattaatttggccccaaatttgatcattttgtaatccaccttgactcatgctctggggatgctgaacattgtggcgtgaatgtgggatgacactgatgatatggatactgtccttttaggatttcttggtgtctctgtggagccattgagccttaccccttactggaggctgcaggaccctctacacacagacagctgtccagcacggaaggtgggctgaggcccagggtgaacatgccagctaatgggacatcaccccagagattccctgccctgattccaggagaacctggcagatcttttgaggtaaggaggaggatcctatttttttctatatgttctttatttttttatttatttttagttaaatttatattttgagataattgtagattcaaatgcaatgtaccatttacctagtttttgtccccagtagtaacatctcgtaatacccaggatattgacatgcagagcatttccatccccacaaggatcccccatgttgtcattaaatagacacaaccacttcacttcctccatcactcccctcttaaccctggggcaccaccaatctgttctccaatactataat[143 bp omitted]tgtactaaaaatacaaaaattaaccaggtgttgtggcacgcacctgtactcccagctactcgggaggttgagaccggaaaatcgcttgaacctggaggcggaggttgcagtaagccaagatcgtgccactgcactctgcctgggtgacagagtgagaccctgtctcaaaaaaaaaaaaaagttttatttgccgggcatggcagctcatgcctgtaatcccagctcttagggaggcagaagcaggaggatagtttgagcctaggagtttgagacctgcctgggcaatatagtgagaccctgttctccacaaaaaggaaaaaaaggacaaaaaagagagactgttatattaatcagattgtacagtatgtaccttttgggactggctttcgtcattcagcaaaattctgtggagatatcaatagctaacagtatatcaatagttcattcattttttttgagacagagtcttgccctgtcacccaggctggactgcaatggcgtgatcttggctcactgcaacctctgcttcccgggttcaagctattctcctgcctcagcctcccgagtagctggtattacaagtgcgtgccaccacacctggctaattttttgtatctttagtagagacggggtttcaccatgttggccaggctggtcttgaactcctgacctcgtgatccacctgcctcagcctcccaaagtgctgggattacaggcgtaagccaccgtgccctgcccattccttttattgctgatacttttccatcgcatggatgtaccaaacagtataaccattcactggttgaaagacatcttggttgtttctagttgttggatattatgaataaagatcctataatagtttgtgtaaggtttttgtaggggtgtgatactgtgaaatatataattggtctttcctggcaaacaactcctaatatcctcggaatctctaaagtactaaagtgtctttttgtatgctaatgagttgactgatgcctggcagtccctaggcagcttccgaatggggctggtcaccagaaagactaaggtaggtttagagggttgggaccctccaaccacctgggaggggagagggtgctgagagtcaagtcgatccacaagggcaaatgatttaatcaatcatgcctacataatgaagcccccctaaagccccaaaaggataaagtctggagagcttctgggtagccgaacacatgggggttcctggagggtggtgcacccagagagcgcatgaagactccaggccccttcccacatgccttgccctatgtatctctttatttggctgtgatttatttgtattctttttttttttttttttgagatggagtttcgctcttgttgcacaggctggagtgcaatggcgtgatcttggctcactgcaaactccacctcctggattcaagtgattctcctgcctcagcctcccaagtagctgggatcacaggcatatgccaccacgcccagctaattttgtatttttagtagagatgaggtttctccatgttggtcaggctggtctcaaactcccgacctcaggtgatccacctgccttggcctccaaaagtgctgggattactggtgtgagccaccatgcccggcctgaatttgtattctttaaaatatcctttattggtgggagaggccggagaattgcttgagttcaggaattcaagaccagcctgggcaacaaagtgagacctcattactacaaaaaataaagctcaggtggggcacggtggctcatgcctgtaattccagcactttgggaggccgaggtgggaggatcgcttgaggtcaggagttcaagactagcctgaccaacatgataaaacctcatctctactaaaaatacaaaatttagctgggtgtggtggcgggcacctgtaatccagctactcgggaggctgaggtaggagaatcacttgaacctgtgaggcggaggttgcagtgagccgaggtcgcaccactgcactctagcctgggcaaaagagcgagactctgtcttaaaaaaaaatcctttataataaatcagtaaacatagtcagttttgtgtttcctgttgagggtgagcggccactgtctgggccggtggctcacaggtaaaagaatttaccacgacagttgtaggtaaagaaaggcagatttattagagaaaggaggaaaatacattgcaagagagcaacaggtagaatcagcaaaagaggaactgacttcgaggaaatgaaggcttgctggagattttataggatggttcttgggctgtttgataacgccaaggtagcagggagctaacttgcattcttctgtcagccaaggtgtttgatgatgaattggagtgtttgatgataagcaggaagtttgtgagttatgtacattatttgctcaagaagactatatgtcctgggccataaagaaagacagacctataacttaaacttatctgcatcttctttttgtttatatgtcctggagcaactccttttccctaattaggactccacatttccctgagttttttttttttttttttaaatgcagggtctctctgtcgcccaggctggagtgcagtgacagcttgcttactgcagcctcagcctcccgggttcaagtgatccttccaagtagctaggaccacaggtgtgtgccaccacgcccggctaattaaaaaaaatttttttttttttaacagatgaggtgtcactttgtttcccaggctggtcttgaactcctggcctcaatcaattctctctccttagcctcccaaagtgctggcattacaggcatgagccactactcccagcctttccttgagttctatgagccactctagcaaattaattgaaccctaggaggggattgtgggaagcttgacttgtagctggtcagtacgaagctctggagtctgaagtgggggtagtcttcagaactgagccctcaacctgtgggacctgatgctatatcctggcagatagtgtcagaatggaattgaattggaggacacccagctgttgtctactgcagaattgacctcttgcttgatgtgtgaggaaaatccctcactcatctgttgtcacagcatgttatgagagtctagtaggagaaactgtgtttgtatttctactcctacacagtggggtaaatgcatgtgagaaca[132 bp omitted]cctctgcctccccggcccaagcgattctcatgccttagcctcctgagtagctgggattacaggcacccaacaccataccctgctaattttttgtatttttagtacagacagcgtttcaccatgttggccagactggtctccaactcctgacctcaggtgatccacccgccttggcctcccaaaatgctgggattacaggtgtgagccaccacgcccagcaatcttttttttttttttttttttttgtgagatggagtctcgatctgtcacccaggctggagtgcagtgatgcaatctcggctcactgccacctctgcctcccagcttcaagctattctcctgcctcagcctcccaagtagctgggattacaggcacccgccaccatgcctggctaatttttttgtatttttagtagacatggggtttcaccatgttggccaggttggtctcaagctcctgacctcagcctcccaaagttctgggattacaggcgtgagccctgagcccggctgacaatcttttttttttttttttttttttttttttttttttttcagacagagtcttgctctgtcacccaggctggagtgcagtggcacgatcttggctcactgcaacctctgcctcccgggttcaagtaattctcctgcctcagcctcccgagtagctgggattacaggtgtgcaccaccatgcctggctaatttttgtatttttagtagagacagggtttcaccatgttggccaggctggccttgaactcctgaccttgtgatccacccacctcggcctcccaaagtgctgggattataggcatgagccatggtgcctggctgataatcatttttaatacagttttagaggtacagaaaagttaagatagtacctataattccatatgctgtcacctcctcaaccccccccacaactggtgcagttttccctattattcacatcttgcattagtgtggtacatttgtaaaaattaatgaactgatagtgatatattactattaattttagcctacagtttatagtaaggctcactgctttgtgttgtacataggggttttggcaaatagatcatgacatatatccaccagtgcagcttcatacagtttcattccgtttcacctgtgcttcagcgattcatcctgcctttccctctgcccgaacctctatcaaccactcattttttactgtctttgtagttttgccttttttttttttttgacactgtgcctcactctgttgcccaggcaggagtgccatggtgtgatcactgctcactgcagcctctacctcccaggctcaggtgatcctcccatctcagcctcctgggtagttaggaccacaggcacatgccaccatgtctggctaattttcagtattttttatagagacacggttttaccatgttgcccagtgtggtcttgaactcttgggctcaagcaatttgcccacctcagcctcccaaagtgctgggatttacagatgtgagctattatgccaggtctagttttgccttttctaaaatgtcatgtagttggaatcatgcagtatgtagtcttttcaaactggcttctttcacttagcaatttgtatttaaggttcctccatgtttttttgtggtttgatagttccatgaattggaagtaccacagtttgcttattccttcacctaccgaagggcactttcattgtttgtaggttttagcaatgatgaaaaaagctactatgaacattcatgtgcggatttttgtgtgaacatgttttgaactcaattggctaaataactaggagcataattgctatgtcatataagctttataaactttataagaaactgcccaggcagggcgtaatggctcacacctataatcccagcactttgggaggctgaggcaggtggatcacctgaagtcaggagttcgagaccagcctggccaacatggtgaaatcccgtctctactataaatacaaaaaattagctgggtgtggtggcaggtatctgtaatcccagctacttgagaggctgaggcaggagaatggcttgaacctgagaggcagaggttgaagtgagccacgatcgcgtcattgtactccagcttgggcaacaagagtgaaactccgtctcaaaaaaaaacagagaaacttcccaactgtcttcccaagtttttcaccattttgcattcccaccagcaatgaatgagtattactgttactcctcatcttcaccaatgaaaccaccattgcaaaattgtaactgagacagtgaaagagatctaatctgatcaaccccatctttcttcaaacctccgagctgtccttgttcattcccgagcataggctgaactaacttagggaggaacttagtttgtagtttaaaacaaagatgttaacaggcttttcccaaggcaaatcccctgcttgcctggggactagattgcctttgtaggaataacaagttagccaccagatagaaattatggtttaggagtcatgcagccggagactacaagattctgaccctctctaaactgctcctaagatcagtgcttgagatattttgcagaccctggacctaatggatcagctggcaacacccagatcgataaattggctcatctgatcttgtggcccccacccaggaactgactcagcacaggaagacagcttccattccctacggattcatctttgacctgaccaatcagcactcccggcttacactggctctcccctacccctgccccccaccccaccaaattatcctttaaaaactctgatccccaaatgctcggggagactgatttgagtattaatacaactctgggtctttgtgaattactctgtgtgaattactctttctctattgcagtttctctgtcttaataaatctgctctgtctgggtaacaggcaaggtgaagccattgggcagttacaccagcatttggtattgtcagctttttaattaattaattaattattttgagacagtgcagtggtatgatcacagctcgctggagcctcaacctccccaggttcaggtgattctcccacctcaacctcccaagagtagctgggactacaagcatgtgccaccatgcctggctaatttttgtatttttagtagaaatggggtttcaccatgttgcccaggctggtcttgaactcctggcctcaaatgatcctcccgcctcagcctcccaaagtgctgggattacaggtgtgagccaccatgcccagcctttttttttttttttttaaaaaaaaccacattctaataggtgtgtgatcctatctccttgttttaatttgcaattctctagtgacatgatgttgaggacctttttatatgcttatttaccatctgaatgtctttgatgaggtcatcttttcagatcttttgcccactttttaattgagtagtttgttttcttattgttgagtttaatagttctttgtacgttttggatactgtaacctcccaatgggttccccttgcccgctgcctagacagagctgatattaagacaggggaactgcactagagaaagaataattcacgcagagccagctgtacgggagactggaatttttattattactcaaatcagtctccctgaaaagttggggatcggagtttttaacgataatttggtgggtaggggccagtgagttagaagtgctgattggtcaggtcatggatcaaatcataggagttgaagctgtcctcttgtgctgagtcagtgcctgggtgggggccacaagaccagatcgagccagtttacggatctgggtggtcccaactgatcaattaagtgcagagtctgcaaaatatctcaagcactaatcttaggttttacaattgtgatgttattcccaggaacaatttggctagagtcagaattttgtagtctctagttgcatgactcctaaatcattacttctaatcttgtggctaatttcttagtcctacaaaggcagtctaatccccaggcaggaagggggtttgttttgggaaagggctgttatcctctttgtttcaacgttaaactataagccaagttcctctcacgctgggcgcggtggctcatgcctgtaatcccagcacttaggccgacgcaggcagatcacctgaggtcagaagtttgagaccagcctggccaacatggtgaaacctcgtctctacaaaattataaaaattagctgggcgtggtggcctgcacctgtaatctcagctactcgggaggctgaggcaggagaatcgcttgaacccaggaagcggaggtagcagtgagccgagatcgtgccactgcactccagcctgggcgacggtgccagactgtctcaaaaaaaaaactaagttcctctcaaagttagtttggtctgtgcccaggaatgaacaagggtagtttggaggttagaagcaagacggagttggtttaggttggatctctttcactgtaataattttctcattataattttacaacggtagtttcaatacaagtcctttatgagataagtgttttgcaaatattttctcccagtctgtggcttgtctattctgtcatcagcgtctttcacagaagagaagtttctaattttaataatgcacaacgtactgttttttttttctttcacaggtcatacttttggtgttgtattcatatacatatatatttttatagagatggggtctcactaggttgcccaggctggtcttgaacgcctgggctcaagcgatccacccacctcagcctcctaaagtgctgtgattacaggcatgagccactgcacttggctggtgttgtatttaaaaactcatcaccaaacccaaggttacttggattttcttctttgttatcttatagaaattttatagtttttcattttacatagagatctataatccattttgagttaatttttttttttttttttgagacagggtctgcactccagcctttgtcacccaggctggagtgcggtggtgcgatctcggctcactgcaacctctgcctcctgggttcaagcaattctgcctcagcccctggagcagatgggactacaggtgcacaccaccacaaccgactaatttttgtatttttagtagagatggggtttcaccatgttggccaggctggtatcgaactcttgacctcaagtgatgcactgccttggcctcccagttttgagttaatttttgtgaaacatataaggactgtgtctagatgctttttttttttttttttttgcatatggatgtccagttgttccagcaccatttgttgaaaagacttatttcttcaccgaatttcttttgctcctttgtcaatgatcagttggctgtttttgtgtgtatatatatttctaggttctctattctattccattgatctatttgcctattctttcaccaatacctctgtcttgattagtctagttttatagtaagtcatgaagttgggtggtctcagtcctctgactttgttcttgtttagtactatgttgactactttggatttttgcctttccatataaactttagaatcagtttgttgatagccacaaaataatttggtgggaatttgattgggattatgttgaatctcctgatcaaggtggggacaattgacatgttaacagtattgagtcttccctttagcagcagagaatccatacgggtctgcagcaacctcaattcttgcctcctcagaaaaaagaatttgaggggcataagacagagtgagagaccagggcaagttttagagcagtagtgaaagtttattaaaaagctttagagcaaggatgaaaggaagcaaactacacttggaagagggccaagcaggcgacttcagagatcaaatgtgcggtttgactttgacttggggttttatgcttcctgggtctatattacccctcctttgattcttaccttggggtgggctgtccgcatgtgctgtggcttgtcagcgcttgagaaggggccgcatgcgcattgtggttactgaagttctacgcatgctcacttgaggagtttttcccttaccagcggagtgttcctaaaggaaggttatataccagttaaactcggccattttgcatcgtagtgcacatgtcttgagcccactggcccaactcctgagatcttattgggaagctgctgatcaccagtttcaggttttttggtatctgttgagagactgcctttccctggcgccagctgcaaccaattattatttttatttattattattatttttcttttttattattatttttcttttttttttaggaggaacaggagaagcaggaggaggaggatgagcaggagagaaaggaggaggagaaagaggaggaagaggagcaggaggaggagaaagagaaggaggagcaggaggaggagaaagagaaggaggagcaggaggaggagaaagagaaggaggaggaacaggaggagcaggagaaagaaaaggaggagcaggaggaggaggagaaagagaaggaggaggaggaggaagaggagcaggaggaggaggagcaggaggaggagaaagagaaggaggaagagcaggaggaggaggagcaggaggaggaggagaaagagaaggaggaagagcagaaggagaaagagcaggaggaggaggagcaggaggaggaggagaaagagaaggaggaagagcagaaggagaaagagcaggaggaggagaagcagcaggaggaggagcagcaggaggaagaggagcaggaggaggagcagggagcaattattattttagagagacagttttaacaactgcctgaccatcacctcctggtggggtttgagggggggtgctctcctgctctgctcatgtctaactacctaactacctaattactctaacatttctgtcaataaacatgcaatatctctctgtttacttatatattctgatatatttcatgtcaaattttgtttgattttcctcatgtatgtcttctacatattttgttaggtttatgtatattttatctttttggtgctaacgtaaatggtattatgtttttaattttaaatatcaattgttcatttcgggtatataggaaaacaattgacttttattaagcctgtatcctgtgactttactataatcacttaatagtgccagaaaatcctttactgaaatggattgtgagagtagctaaatgataggggtagtatgtttgattttgaatgctgtagagtggaagagcatgtctgggttgatgcaggacccacagctcatagtgaccaatcacagatggctgtacttgagccagacacacaaaaacacaagaagttattcatgagggaagacctagcatgccagacttgctcaaagccactgtaaagtgtgtttaccctgtcagcggaaagagtcaaattctgtaaaatatttgaagagacttattccaaaccagcactcaggagatactgagaacaggtgcccaaggtatgtgttagatgtccactgattcggttcggaaaggcgggacaacttgaagtgggggcttccaggtaacaggtagataagagacaaaaggttgcattctcttgggtctttgatcagcttttcactgaatacataatttacatgtgagaggggatagaatagtctgcctaatgaaacaacagggcagaggaagcaatcagatacccatttgtctcaggtgagcagagggaggacattgagttctgtctgtcctttgtcatcctgcacctgtgaagataagctatcaatttacgttgccagggtgaaattcaacagaactttttttttttttttttttttttttgagacgcagtctcgctctgttgcccaggctggagtgcagtggcgtgatctcagctcactgcaacctctgcctcccgggttcaagcgattctcctgcctcagcctgcgag[132 bp omitted]ccacaaggtcttttcttgtgggcaaattgcgagggaggcatgtagccttttttttttttttaatctttgtagctatcttatttgggaataaaatgtgaagcaggtttgcctaacaccctttggcttaatgattttggagtcctgagatttattttccttcacaaccctaagtataggactgtgtaacatatgccaagaggagcacccctgatgaagcagctgataggcttcatatgcaggccatgtgggactggctttatggtgcctatgatattcacccactgaatatgcccattacccaggccatattcagctatggttaaggggtctttttgcataggcaccccatgtaaacttacagctgcaaaatacagcaatagacccaaaagcctcattgaatttgctgcctcagcttcccttcagggatcccacagctgctaatgaaaacattaagttaacgtgaaaatggggagaagcctagggaagggtcaagtctaccagcaaagtgga[248 bp omitted]ggttgcagtgagctgagatcgcaccactgcactccagcctgggtgacagagagggactcagtctcaaaaaaaaaaaaaaaaaaaaaaaaaaagaaatgggatggctgggctttgtttggtggctcacacctgtaattccagcactttgggaggctgagacaggtggatcgtttgagcccaggaattcaaaaccagcctgggcaacatagcgaaatcccatctctacaaaaaaaaaataataaataaaaaaaattagctgagcatggtggtgcacgcctgtaattccagctgcttgtgaagctgaggtgggaggatcacttgagctggggaggtcaagcctgcagtaagccatgatcgcaccactgcactctgtctcagaaaaaaaaaaaaaaaaaaaaaaagaccaagggcaaaggttctttggctccaccccgggatggggacccaaagctttgtgcacatgaaatgggtggtgaagagaagtttctgggtaaaatgggaggaaaagagaactttctgggacccctttatatggaagcctcatacacggaggtaccaaaatccattagtgaagctgtaacatgggctacaactagactgggagaatatagaaatgtaacagttgataggattaaggtgtacatttgggtgaaaattggaatgtgtttaaacaggctttgtggctgggtgcggttgctcacccctgtaatcccaccactttgggaggccgaggcgggtggatcacttgaggtcaggagtttgagaccagcctggctaacatggtgaaaccctgtctctactgaaaattaaaaaaaaaaaaaattagctgggtgtggtgacatgtgcctgtactcccagcttctcaggaggctgcagtgagccgagatcgcgccactgcactccagtctaggtgacagagcgagacaaagtctcaaataaataaataagttttttttaaaaaataaaaataaacaggttttagctgaatgttttatgggaatggatattatgactgacagggaacacttcccttaactagtattgtgacactcaaacctgttgatgaaatcccaatggaggaatgtaagggttgatgggattaaggtggaagtttggaaaatttgtagatttgaacaggctttatttgaaatggttgcatctcttttacctcaatgtattatggagattgaaattgtatctgactgtggaatgtttcccctctctagtattgtaaattcacccttcaaccagtattacttgaacatgctaaacgggaaccagtaagattgccgaagcccacgaagtatacaatagaacctggggtgccgcacagacagattacctgtacaatagccctttgtggagcagagaccggcgcttatggcaaaagcctaagagcgcctcctagtggtaacctgggactttggactagagaatttccagttgagcttggattagacattaattgaaagtgcccttatgattgaaggacataaaataattttgaaacctaaaatatccatgatgtcttgggtgatggtgtaacgctccaatagggagtgcagtgcccagagtagttccataattacatggaaatggttcgtacaagaatatgctgccaggggagtgcggaattagcggttttcacaaccaggtagactcctttccgccgggactgatggaggaggagctggtcggttctgtcatcgactggacaatgctccagctctcaactgaccaacaaaaagatgcttggtttgtggatggcagttccaaggcgaatggactgcatcgtgtttggatgtcccaatggcgtccattatagcaaaaggatccaatttaggattatgtttagcatttacgtgtcatcactttagtgttattcagttgagaaggttccttctttgcctctcataactctttgaagatttaattaaataatagtatttaagtatttacaaatttatattcttctcatcatataaattggaataatgattactgaagcagatctgaatagtcatacaagtaagtatatagaatatatattagttaccccagagcatgaagagagaaattcccatgagctaaatattcacatgatggattttacggtgttactctaagtccagtccacctagcatttccagttgagcacacccttcctaggtgaaatgatagaaagaataacaaactcttgagtgctagctctgtatcagtgctgccctaagcgattccgtgtgtgtgtgtgtgtgtgtgtgtgtgtgtgtgtgtgtttgagacagagtcttgctcatgttgcctaggctggactgcagtggcacgatcttggctcactgcaacctctgcctcccgggttcaagccgttctcctgcttcagcctcctgagtagctgggattacaggtgcgtgccactacgcccagctaatttttgtatttttggtagagacaggatttc[132 bp omitted]tcacagatgacaagactgaggctcagaggaaggtagtaacttagccagagtaatagcacgagtgtgagtcagagccaagatttgaacccaggcagcgtggctcccaccaccatgttcttgcttgttctcttctgtgtccaggagattccttcctacctgaccttgttctcgacgctctctggttacttctgcatagccacagtctaaagcagttatacaaccatcctaggtgagctatgcatttttaaaaattaaactttgattttgagatcagtatcgattcccatgcaattataggaataatacagagagatcgtatgtgcgctttatccagtttcttccaatggtaacaccttccagaacaatagcacaatatcacaaccaggatgtggccattgacacaaccccaggatgtctcctgctgccctttcacaaccacacctgctacccttgttcctgccatctatcccctcgaggttcctaaccccgacactaatctgttctctatctctagaatgttgtcatttcacgagtgttatataaatgaaagtatacagtatgtgactttttttgtttttttttgagatggagtcttgctctgtcgtcaggttggagtgcagtggtgcgatctcggcttgctgcaacctttgcctcccaggttcaagcaattctcctgcctcagcctcccaagtagctgggaccagaggcgtgcaccatcacacccggctaatttttgtatttttagtagagatggagtttcaccatgttggccgggctggtcttgaactctggacctcaagtgatctgcccatttcagcctcccaaagtgctgggattataggcatgagccacgccacccggctcccaatttgccctttatttatttgttatttatttgcttgttgcctttgtttcctgtgtattttaggatgcttctaagtataaataaatacgtattagaataaaaggaagaaaaaaaagaagaaaatatcaatacaagttttagaaagtaggcatgcctgtcagcaatcctactgagcctactgaacaagaaaactttgcagtcttttttttgtttttgttttttttgagatggagtctcactctgttgcccaggctggagtgcagtggtgtgatcttggctcactgaaacctctcttcaagcgatttcgtccatcagcgtcccaagtagctgggactacaggcgtgcaccaccatgccctgctaatttttttttttttttgagtcagagtttcgctcttgttgcccaggctggagtgcagtggcacgatctcagctcactgcaacctccgcctcccggattcaagtgattctcctgcctcagcctcccgagtagcctgggattacaggcatgcaccaccatgcccggctagttttgtatttttagtagagacggggtttctccatgttggtcaggctagtctcgaactcccgacctcaggtgatccacctgcctcagcctcccaaagtgttgggattacaggcatgagccaccatgcccagcctgatttttgtagttttagtagatggggtttcaccatgttggtcagggtggtcttgaactcctgagctcaagtgatccgcccatcccagcctcccaaagtgctgggattacaggcataagccaccatgcctggtcctgaagtcttgcttaatctgtatattctaggaagacacagcagagcaggagctgcaatcaagaattacaatgcctcagtcgggcgcggtggctcacacttgtaatcccagcactttgggaggctgaggtgttctcaggagttcgagaccagcctggccaatgtagtgaaacccccatctctactaaaaatacaaaaactagccaggcatggtggcacatacctgtaatcccagctacttggaaggctgaggcaggagaatcacctgaa[135 bp omitted]ttcctgatatttaaatttttttattactttattattattttcttagagaattacaatgcttctacagagaaatcagtaattcctttatagtggagagttcctgatacttaaatttttttattactttattattattattttcttagagacagggtcttgcttcatctcccaggctggagtgcagtggcacaatcatagctcattgcagcctcgaactactgcactcaagtgatcctcccacctaagcctcctgagtagcagtgactacaggtgcttgtcatcacgcccagctaatttttttgatttttagtagagatgaggtctatgttgccctggctggtcctgaactcctgagctcaagtcatcctcccgcctcagcctcccaaagtgctgggattccaggcctgagccactgtgcctggctatgtgtttttttgttttttttttttgagtcagagtcttccacctgagtctcccgaatagctgggaccacaggcgcacaccaacatgcctggctaattttttaatttttatttttgtagagacagagtctcattatgttgtccaggctagtctcgaactcctggcctcaagcactcctcctgcctcagcctcctgagttggtgggattacaggtgtgagccactgcatgcagcagttcctaatacttgagtgtcaagaaatcctctggggtgtgctcagagcagggggcctgaagaatgcttcttctgtttacaacacacccaataggaatctggggtcattgtgacggggggcacaaaacttgtgacctctctatgaacaaatgccccacatgtgaaaaaaagaaatcttttgttaaatcttcatacggatgatggaaacaatattttcttttcttttttttgagatggagtctccctcttttgtccagcctggagtgcagtggtgcgatctcagctcactgaaacctctacctcccaggttcaagcaattctcttgcctcagcctctcgagtagcaccaccacgcctggctaatttttgtatttttagtagagacagggttttaccatgttggctgggctggtctcgaactcctgacctcaagtgatccatccgcccttggcctcccaaagtgctgggagtacaggtgtgaaccaccacacccggccggaaacaatattttcaattacaaccttgtcataagtgatattacaggtcttctgtggctatttgtcatttgaaaagattttttcattaattttttttcttttttcttttttttgagacagagtcttgctctgtcgcccaggctggagtgcaatggcagatctcagttcactgtgacctctgactcctgggttctagcgattctcctgcctcagccttccaagtagctgggagccattaatttttttttttttttccaagacagagtcttgctctgctggtcaggctcaagtgcagtggcctgatcacagctcactgcagcctcaatctcccaagctcaagcagatcttcccacctcagcctctcgactagctgagactacaggcgcacgtcgccatgcctggctaattttttaatttcttgtagataggaggtctccctatgttccccagtctctctccttggtctcattcagtttt[132 bp omitted]caaaaccccgtctctactaaaaatacaaaaattatctgggtgtagtggcacatgcctgtagtaccagctacttgggaggttgaggtgagagtattgcttgagtccagaaggttggggctgcagtgacccaagatcatgccactgcattccagcctgggcaacagagcgagaccctgtctcaaagaaaaataaaaggaagcagtggttattgcatattgtactgtacttgtctcgctaccactgagtagaatttgcattccacgtattttcatctttaccatcctcttgaatcttcagtctatcttcccttcctgtttgatgtcttcatgcttttccagcactctttttctggctggttctatttttttctgagttggtagatggtgcacaatttgagttttctgatgattttattctcaaagaagcctgtgtgggaggagcattactaaataaggaagtgctagtcaatatccagatgactagaaatggataaagtattgttcccaacagggatccagtgtccccacgggatgagcataccttggatatagtcagtcttcctatctgtgcctcaaactgctgtgctgcttcttaaggagcttccaaagggaagctgatttgtgaagggagaaccatcaaaaagacagaattgaatgactgcagtagtgcttctttgtcttgtataagatttcctcttgggctgggcacagtggctcatgcctgcacaaaatgcccagcactttgggaggccgaggcgggcggatcacctgaggtcgggagttcgagaccagcctcaccaacatggagaaaccccgtctctactaaaaatacaaaattagctgggtgtggtggtgcatgcctgtaatcccagctactcgggaggctgaggcaggagaatcacttgaatctgggaggtggaggttgcagtgagcccagattgcgccattgcacgccagcctgggcaacaagagcaaaactccgtctcaaaagaaaaaacgttttcctcttgaattccatttctgcctgtttttagcagagcagcagctttggcagcttctctctctgtctctctgtctctgtctctctctctctctcatctggtctttgtgaaatgagcagcactctgcgtgattccatgcagttgtctgtttcatatgtctttcagctgccctatattctgcctttcctgtttctttgttcttacattctttttgtcaattgttcttgtttcttttgatatacagcatttctctttcagttttccttctcaatttccctcttgatctctttgttcttccacttaccttttcaagtattttggttagtcttagtctgttcactctgacagtgaggttcttggtaggtttttgatttgaccttcctctaagctccctttgaggcaatgacatgccctgatctgtttcctcttgtttaatatatatgactttgtgtcaggagaggtaggtggtgtatcacaaaactcaacatttctgcactgaaagttttccaaagtgttacaagtgttactgggttcaaatgagggatgaaacagtgactaaactttctgactggctcccatttgcaactcatgtttcagtttttagttactgcatcttttggtttactctcttatctgaaatacttggcaccagaagtgttttggattttttttcttattttggaacgtttgagttatattcactgattcgggatccctaatctgaaaatctgaatccaaaatgctttaatgagcatttcctttgagcatgatgttggtgcttgaaaggttttgtattttggagcatttcagattttggattttttttcccctctcctcttctggaaaaagacagagtcttgttctgtcttgcccaggctggagtgcagtggcacgatctcggctcactgcaacctccgcctcctgggttcaagcaattctcctgtctcagtctcctgagtagctggcactacaggcatgtgccaccacacccggctaattttgtatttttagtagagactgggtttcaccgtgttggccaggctggtcttgaactcctgacctcaggtgatccactcgccttggcctcccaaagtgctgggattacaggcatgagccactgcgcctggccaagattttggatttttggactgtggatactgaacctgtattgatttttttttttttttgagagggagtctcgctctgtcgcccaggctggaatgcagtggtgcaatctcagctcaccgcaagctccacttcccaggttcacgccattctcctgcctcagcctcctaagtagctgggactacaggcacccgccaccatgcccggctaattttttgtatttttagtagagacagggtttcacc[139 bp omitted]gatgcttctgtcactttgtcatcttcctaacctgcagccatctgtgtaggctgtttatcatcagctgccatgacactatgacaactgtgatgttactcttggccactgtgatggcaacctgaatggtttcctggaagtatagcatcattcccctctcctcttctggaaaaagacacttgtcattgaatttaggggctacccagttaatccagaatgatctcaactcagatccttaactacatctgcagagatcctttttccaaataacacccaggtaacattcaccgtgcctgggtgttaggatgtggatacatcttttgggggagtgcaccattcaacccactatagtttgttctctagcctccaaatttatgtccatcccacatgcaaaatacattcatcccattccaacatacccaaaagtcttaatgcattacggcatcagtttctgcctgtggatctgtgaaactggaaaacaagttatctgtttccaaaactacaatggtgggacaggcataggacagatattcccattccaaaaggcagaaattggaagtcataaagggttcactggtcccaatcaagtttgaaacccagtagggaaaatatcgttagattaaggcctgaaaaatatcccctgttgaggccgggcatggtggctcatgcctgtaattctggcactttgggaggccgaggcaggtggatctctgaggtcaggagttcgagaccagcctggccaacatggtgaaaccccgtctctattaaaaatacaaaaattagccaggcatggtggcgcacgcctgtaatcccagcttctcaggaggctgaggcaggagaatctcttgaacctgggaggcggaagttgcagtgagccgagatcctgccactgcactgcagcctgggggatagagtgagactgtctcaaaaaaaaaaaaaaatctcctgttgctctgctctcttggcctctgcctcgcccatgcctctgcacctgcggttctgcccttggagtcattcttcctttgtgttgcaggtagcacatgcttataaccagatagttcgatcagcccatttcctgcctataaagttttggaagtctgacagccttctgtcattttgtcttttctctgtttctttctgtttaagctggcagtgtttgtactggtataacattcccaaaagccttgtcactctcctgtatgtgttcgtattagagaagaaggccgtccacagagctttcttggataatcccatctctattcctgattctgctgaaatgggtcatcggatccttgagtatcacaaagagcatgctttcccaacagtgaattttctttcttttttttctttttgagacaaggtctcactctgtcatccaggctgctgtgcagtggcatgatcaccgttcactgcagccttaacctcctgggctccaacccagctgtcctcctgtctcagcctcccaaatagctgggactaccggattgagctaccatccccgccaccctcccccgcccttttttttttttttagacaaagtcttgctctgtcgcccaggctggagtgattaaaccattaaaccactgaccactggtgatcaagtcaaccttcagccactctcccctcccaggaggttgagtatggggctcaaagttccaaccccaatcaggcacttaactaattctgtttattttttgtagagacggggtctcactttgttgcccaggctggtctcgaactctttttttttttttgagatggggtcttgcactgttgcccaggctgaagggcagtggcacgatctcagctcactgcaagctctgcctcccaggttcacaccattctccgcctcagcctcccgagtagctgggactacaggcacccgccaccacgcccggctaatttttttgtatttttagtagagacagggttt[144 bp omitted]ctacagtgctgggattataggcatgagccactgcacctggccaacagtgaattttctaattttagcatcttttacaatctggataggctgagaatctcccaaatcatcaagtactggttccttttggcttaacagtttcttactcaatgtatctcttatgtctcacattttcctgaaagctgtaagaaaaaaccaggccgccccttcaaatacgttgctcgaaaatctctcagctaaataaataccgaagtatttgtgtggaaagtacctctgggtatttccagaataaaattctgttaagttttctgccattatataacaaggatggtttttcatctagtttccaatatcatgttcctcatttccttctgagtcaaaactagaagcacctttaacattcatatttccaacattttgtgcgggatgatgtttgtattctgtaagatgatagaagctttcttagttgtgttacttcctccttctgagccctcctcagcagtgttttttttgttttgttttgttcttttttttggcaagatctcattctattgctcaggctggatggagtacagtggtgtgatctcagctcactgcagccttgacttcccaggctcaagtgatcctcccacctcagcctcccacgtagctgggtctacaggagcacaccaccatgtccagctaattttttgtatttttgttggtagagatggggtctcaccatgttgcccaggctggtcttgaactcctgggctcaacctatccgtccaccttggcctcccaaagtgctggggttacaggtgtggaggcatcaccatgttgcccaggcattgctcacactccttggctcaggagatcctcctgcctcagcctctcaaagtgttgggaatataggcacgagccactgctcctggctagatttttttattcaagaaatgggcgtcttgctatgttgcccaggctggttttgaactcctgagctcaagctatccttctgccttggcgtcttgaatagctggggctacaggtgtatgtcaccatgcctggcttaattgtagatgttaatcacatctacaaaataccttcacagcaacacctagattagtgtttgattgaataactggggcatatatccagtccaactgacacatcaaattgattattgcaatccacccctcattatcttggcacctttacatatctctttaaatcatacttaatctctaaataaagataacaagctcatacttctgcgtaacatgatgcaattctcaagtatacaactaaaaacaccttcttttcctcagaagaggagacaaagtcagtgggtgatgctcacact[142 bp omitted]tgaaaacccatctctacaaaaaatgcaaaaattagccaggtgtggtggcgtgtgcctgtggtcccagctactcaggaggctgaggtgggaggactgcctgagcctttggaggtcgaggctgcagtgagctgtgattgagccactgcactccagcctgggtgagagagcgagaccttgtctcaaaaaatgaatattgtactataatgttaagtattaatagttttcatgttagatgataagaggataagagagggaacaaaacaaatacttgtgatgtatatgcatatatatttatatatccacacacgtatgcctaataaaataaggaagaaatactcataaaaattacagtcctgtagccaggggcagtggtgcacgcctgtagtcccagctacttgggcgactgagggaagaggatccagtccagcctgggtaacgaagcaagaccttacctctaaaaaaaatgatatattggccgggtgcagtagctcatgcctgtaatcccagcattttgggaggccaaggtgggcagatcatctgaggtcaggagttccagagcaatctgaccaacatggtgaaaccttgtctctactgaaaagaaaaaattagctgcacgtggtggtgcatccctgtaatcccagctactcaggaggctgagacaggagaaccgcttgaacccaggaggcggaggttgcagtgagccgagatcgcgccattgcactccaacctgggcaacaagagcgaaactccgtctcaaaaaaaaaaagttatatatttatatatagtcgtaatttatgcagctggtcacatggtcatagctggtatttataactgccttcttctacccattccagatccctttgccctcagcagacacctgagctgcttctttacccgatggggtgacccaaacctttattattgcagagtctgggtgtattagtctgttctcatgctgctaataaagacatacccaagacttggtaatttgtaaaggaaagaggtttagttggctcatggttccacatggctgaggaggcctcacaatcatggcggaaggcaaaagaggagcaaagtcacatcttacatggtggcaggcaagagagcatgtgcaggggaactcccctttataaaatcatccattcttgtgagacttattcactatcatgagaacagcacaggaaagacctgcctccatgattcaattacctcccactgggtccctcccacaacacatgggaattgtgggagcaacaattcaagatgagatttgggtggggacacagccaaaccctatcagcaagctactgttagtcctgcctgaattgggttgttgtagttttcaattgactttaatcacagggcattgtagtgtgctttaaggggtcttctgtgttccaggcctactcttctttatcttcattgtttaatagcaacccagtttctttttttctttctttttttttttttttttttgagatggagtctcactctgttgcccaggctggagtgcagtgatgtgatcttagctaaccacaacctccgcctcccaggttcaagtgattctcctgcctcagcctcccaagtagctgggattacaggcatgcaacaccatgcctgcctaatttttttatttttttattttttttgagatggagtcttgttgtcacccaggctgggagtgcagtagcacaatctcggctcactgcaacctccgcctcctgggttcaagcgattctcctgcctcagccttccaagtagctgggactacaggtgcctgccaccatgcccagctaatttttgtatttttagtagagacagagtttcaccatgttggccagggtagcctagaactcctgacctcaaatgatctgcccgccttggcctcccaaattgctgggattacaggcgtgagccaccgtgccctgctgcaagccaatttcatcttggtagttaggatcagatgctccagccaatacagcaactcccttcttttcctgttgcttcagaggcatgagaagccttaagtggccgtgtggcagtcttagcttccagttcaatgaaatcactgttgtatctcttggtggaagctttcctccttttggaacagagacccctacaccagtggagcataatatcatgaaggtaggaaataaaaattttgctagtaggttactaggggtaatagtgagtagtgccatttgcatttctgtttgtttttgtgtttttttttgagacggagtcttgctctgttgcccaggctggagtgcactggcatgatctcagctcactgcaacctcctccacctgggttcaagtgactctcctgcctcagcctcctgagtagctgggagccatttgcatttttacctccttgattcctggacctgtgaatcctggctatgggagaaatcacaccatatattaaatgcggattcagagaatattcagactcctgcaggacattgccccagcccagcaaggtattgccacctagctggcactgtaactgagtcttcaaaaagcatggtgaggaacatggtgagacttgtgaattccatgagcatggtcccattgccccactccttttgctgtgaaataagttccttggtcagaagcaatgctttgtggaataccatgatggtggatttcctttgttgcataacccatgtattcattcctttactttcagctattatttctttttttatttctttttctttttctttttttttgagagagagtcttgctttgtctctcaggctggaggctggagtatagtggcacaatctcgtctcaatacaacctccacctcctgggttcaagcgattctcctgcctttgcctcccgagtagctgggattacaggctcatgccaccacacccagctaatttgtgtgtgtgtgtgtgtttttttagatgaagtctcactcttgtcactcaggctggaatgcaatggtgcgatcttggttcactgcaacccctgcctcccaggcccaagcgattcttctgcctcagcctcccgagtagctgggattacaggcgcctgccaccatgcccagtatttttagtagagacagggtttcaccatgttggccaggctggtctcgaactcctgacctcaggcaatctgcccgcctcagcctctcaaagtgctgggattacaggagtgagccactgcacctggcctgtattttttagtagagacggggtttcgccatgttggccaggctggtctcgaactcatgagctcaggtaatccgcccgccttggcctcccaaagtgctgggattacaggtgtgagccaccgtgtccagcctattctttctatttctctctatttgtcactgatttctacccacacactgttctggtccaggttgctggcaacaatattggtctagcaaatgcctccccattggtcttttcccattcatatagcatatggttatattggtaccaaactcatggggtatctcaaccactagacagtgcatctggattcactgtcaaccgcaattttgtcagatggggtgaaggcacaatctatctcattaggcccataggaattttggcatatatatatttttaaagtatagttacagattcttgctaaggatcatctctgcttccagcacccacagttgtagccctggtcctggaaccattgcaacaaggagtaagaaagaaagtttaggtaatataggggagaattgtatagtcatattagcatcctcccccatcacctttacacctcatctctcagaaaagtggaggaatctcggaatctatctagcaagaatgttccattgattctgctcatgttgactgtgagcacaaacttgggaaggtgtgtaagccagctctttaagcccatgtctcctctctctttctctctctctctgtctcttttttgagacagggtttgggtctgttgcccaggctgcagtgcagtggtgtaaccttggctcactgcaacctcagcctccagggctgaagcaatcctcccacttcagcctcctgagcagctaggtttacaggcatacaccatcatgcctagttaatttttggaatttttggtagagatgtggtctccctatgttgcccaggctggcctcagattcttgagctcaagtgatcctcctgcctcagcctcccaaagt[131 bp omitted]acctctgcctcccggatttcagtgattctcgtgcctcagcctcccaagtagctgggactacaggcacgcaccaccacacccagctaatttttatatttttagtagagacggtgtttcatcatgttg[137 bp omitted]tttagagacagggtctagctatgttgccaaggctcgtctcaaactcttgggctcaagggatcctcccaagtcggcttcccaaagtgctgggattataggcatgagctactggacccagcgtttgacagatgttttaattgtccattccaattctgtgcaaaactacaactctgaggatgatatgcaacataatatgtccatttggtgttttatctttttgcccattgttggatactatgctgtaaggtgtgttccttgatctgaagagatgtaacatggcagtctaaattggtgtagtatcttctgtttcttttcttttctcttctttctttttcaagacagagccttgctctgtaaccaaggtggagagcagtggtgctatcagggctcactgcagcctcgacctcctaggctcaggcgatcctcccgcctcagccacctgagtagctggaactacaggcatgtgccaccgtgcctggctaattttttatattttttgtagagatgggttctccctgtgttctccaggctggtcttgaactcctggcctaaagcagtcctcccatctcggcctcccaaagtactgggactataggcatgagaccctgtgctcagtcatgagagctgttcatagggtgccatccatgtggcagtaggagctgtcagttcctctggtggtttcaaagttggtcttagaggaaatgctgaatacgatgagtactgccttgcaatcctccagtagcatgtcctcgtataaactgtttgcattatattatggaactcttctgggcattgccttccttattagaatgtttctctgacatcacctaggacattatgggtatttcaggtttcaagattattttatctttcattcacaaaaaaatcaccataccaccacatctggaaattctctgatccaaaacctcagccattgctgttgggtagcactcacaggcttttgccacaatctccagtctctataaatacaagttgcagacattttcaaaatcatgtctgcctgtggatcttatataagggctcaaaagcatcaagagagtgtctgctctttgcaattcagacatagcctgcgtaaatatggccttcttttgtgctgtttaatggagggaagctagcaatattctcagatgtggaacatgcatcctgcaaatgacaagtaacctgattaggtactgtgtttctcacgtagtaccaggggtagtaggcagtgacagcagttcatttttttcttgcttggggaatgttaggggtggatcctgcccaggttattcctaagaatttcaccatttgagtgggcctttggatttttgtcgcatttatcaaccacctctgttggtcatgtatgtcactattctatttaagtcagtcctagcttgctcttcagttttttgttttttgagacaaggtctcactatgttgcccaggccagagtgcagtggcacaatcacagttcactgcggcctccacctctctgccccaagcaaacctcccacctcagcctcccaggtagctaggaccacaggtgtgtgccatcacacccactaattttttatatttggagagacagggtctcactatgttgcccaggctggtcttgaactcctgggctcaagcagtcctcccgcttcggcctctcaaagtgctgggattacaggcaagagccaccatgcctgaccgagaacggtagctttatagtaagtgttgaaattaggtatataaatcctctagcttttttcttccttttcaaaattgctttggctgttcgaggcccttttaatttccatatgaattttagaagcagcttgtcaatttctaattattaattttgttttattgattgtgatcaatgttgtttgtaacatatgtatcttaaggaacctaccgaagttgttttctttgtgccctagtatttgaccaaattttgtgaatattttatgtgcacgtgagaaaaagtatattctgtatgatcagggatccaaaagatcaaccttactgattatgtggtttaggtcttttatattattacttatattttgtctatttaatctgtctcattctgtgaatggtatgttaaaagtctcccattagagaatatttctatttcttctttcattcttgtagttttcggcttatataggctgttgatgttactttattgtttgcatttgataaattttttaatttttttttttttttggagtcagagtcttgctctgtcgcccaggccggagtgcagtggtatgatctcagctcactgcaagctccgcctcccgggttcacgccattctcttgcctcagcctcccgagtagctgggtctacaggcgcccgccaccacgcccggctaatttttgtttgtagttttagtagacatggggtttc[142 bp omitted]gttacatgcgtatattgcagagtggtgaagtctgggcttttagtgtcaccatcacctgaatagggtacattaaatcagatgattaaataagctccagactgggcacagtggctcatgcctgtaatcctagcactttgggaggccgaggcaggtggatcacctgaaatcaggagttcgagaccagcctggccaacatggtgaaaccctgtctctactgaaaatacacacacacacacacacacaaattagctgggtgtggtggcagacacctgtaatcccagctactagagaggctgaggcaggagaatcacttgaacccaggaaacagagattgcagtgagccgagatcacgctactgcactccagcctgggcaacaagagtgaaactctgtctcgaaaaacaaacaaaaaaataagctccagagtcttgtactataataccccagtatctagttattattattttttgagatggggtctcactcttgtcacccaggttagagtgcagtggcaggatctcggctcactggaacctcgactgcctgggctcaggtgattctcccacgtcagcctcataagtagctgagactacaagtgtgcaccaccacacctggctaatttattgtatttttagtagagactgggttttgctctgttgcttaggcttgtctcgaactcctgggctcaattgatctgcctgcctcagcctcccaaagtgctgggatacaggcatgagctacctcacctgaccaagatattgtttactcattatacaaaaatccaaaagttatatcaagaaccaggaacatttcaatttgaatgagaaaaaaatcaatgggtgccagcactgagatgatacagagtttagaattacttgacaaggattttaaagcagccatcataaaaatacttcaacaattatgaacacactcaaaacaaactttttaagaaagttttcataaaaaaatagaaatccccagcaaagaaataaaagacataaaaagttgccgggcacagaggctcacgcctgtaatcccagcagtttgggaggccgaggcgggcagatcacttgaggtcaggagttggagaccagcatggccaacatggtgaaaccctgtctctactaaaaatacaaaaattagctgggtgtggtggtaagcgcctgtaatcccagctacttgggagtctgaggcatgagaattgcttgaacctgggaggtggaggttgcagtgagctgagatggagccactgcactgcagcctgtgcggcagagccagactgtttgtttgtttgtttgttttgagatagagtctcactctgttgcccaggctggagtgcagtggcttgatatcggctcactgcaacctccatctctcaggttcaatcgattctgccccctcggcctccctgtagctgggattacaggcgcgcaccaccatgccctgctaatttttgtatttttagtaaagatgggatttcaccatgttggccaggctggtctcagacccctgacctcaggtgatctgcttgcctcggcctcccaaaatgctgggattacaggcttgagccaccgcacctggcagacagagggagaatctgtctgaaacaaacaaacagccataaaaagtaaccaaatggaaattttagaaattaaaaatacaataatcaaaatggaaactcagaaatggactcgacagcagaatgcagatgaaaaaggaatcaatgaacttaagcatagaaaaaagcctgcattatctatatataaatgagtgactgaatatgatgttgtgaaccataatgccagtctagatatctagacttgggtttcaggtatggctttctctaattcctaaccaagtgccctggatattattcttattctctattgtcttgactttgtttatttattatttatttttttaaatttttttttgacttttattttaggtttcgggtactgtattagtctgttctcacactcctataaagaacgacctgggtagtttataaagaatagaggtttaattgacttatggttccacaggctggacaggcttctgcttttggggaggactcaggaaacttacaattatggtggaaagtgaaggggaagcaaggcatgtctcacatggcagcaggagagagagagcaaagggggaagtgccacacactaaacaaccagatcttgtgagaactcaatcactatcacaagaagaagggggaggccggacgtggtggctcacatctgtaatcccagcactttgggaagctgaggcgggtagatcacctgaggtcaggagttcaagaccagcctggccaacatggtgaaaccccatttctactaaaaatacaaaaaattagctgggcatgatggcatgcgcctgtaatcccagctactcaggaggctgaggcaggagaatcgcttgaacctcagaggtggaggttgcagtgagccaagattgcaccattgcactccagcctcagcaacaagagcaaaactctgtcttgaaaaaaaaaaaatgaacaagggggaaatccacccccatgttccaatcacttcccagcaggcccctcctccaacgctgaagatcataattcaacatgagatttgcatggggtcacagagccaaaccacatcaggaacatgtgcaagtttattaggcatttggtaaatttttgtccaaccctttaattttagccttttgcatgactgtgttttaatcatgtctcttgtatgcagcatagtgctgggctttgctttatgaggcaatattaaaccctttttattttatttatttttttgattgtataggtttttattttattactcacctaaacattgctgacccatcaatagaacagcccagccagacatacgtaatagtaatcaaatacatttgtcttttgtactttgcttttacatggaaaacatagcttttacatatttttaggtttttttcatttttatttttcagtttcttttttatttcaataggttttggggaatggttggtgtttggttacatgaagaagttctgtagtggtgacttcaaagattttggtgcacccatcacacaagcagtatacccaatgtgtagtcttttatccctacccccctaccctttcttctcagtccccaaagtccattgtatcattcttatgcctttgtgtcctcatagctttgctttaatgttttattaaaaatattattattattattttaaatagatagagttggtatcttcctatgttggccaggatggtcttgaactcctggcctcaagcaatcctcccacatcagcctcccaaagtgctaggattataggtgtgagccaccacatttggctccctttttcctttaataagcgaattaagcccattcgtatttattcgcgttactgttaagcttggtctcaattctctcattttattttatgttataatcactgtggtatatattttatttactgtatttctttctctctctctctctctctttttctttttttgagacagagtctcactctgtcacccagactggagtgcagtggcgagatcttggctcaatgcaactttggcctccccggttgaagcgattctcctgcctcagcctcctgagtagctgggattacaggcacgcaccactacacctggctaattttaaaaatttttagtagagacagggtttcgccat[137 bp omitted]cagtcttgctaagagcttctttgtagattccttaggattttctacatagacaatcatattgtgtgagaacagagacagttttatttattctttccaaccagttatatgccttttatttcctttttcttgcctgatttcactaaagtaggactttgaataggattttgatttcgaataggattcgtaaaagtggacgtctcttgcctttttcctgatcttctagggaaagcattcagtctttttcattacatatgatgttagctgtaggtttttggtagatgatctttatcaggttaaagaagtttccttctattcctactttgatgagaggttttgtcaggaatgaatgttgaattttgtcaaatgacttttctatatcaattgatgattgtgtggtttttctgttttagtttcttaatatggtggattatattgattgatttaaaaatgttcagccagcctcacgttctctggataaacaccaactgatcatgctatgtgtttacatatgttgcttgatttgatttgctaatatttgttgaggctttttacttctatgtttataagggatattggactgcaattttcttttcttgtcatgtctttgtctgattttgtaatcaggataatgatggcctcataaaatgagaagtgtccttgtctagaaaatggaagaggaaagactgtatagaattgatgtattccttaaatatttggtagaatttactagtgaaactatcaaggcctgggaatttcttttttggaaggttttaaaccacaagttcagtttatttaattgatattccattcagttgtctgtttctctttgggtaagttttggtgttttgtatatttcatggaattggtccatttcatctaagttggtgaatttatgtgaataaaaatgttcgtggcattctcttactctcattttaatgtcgttagaggtatatagtaatatctctttgttttcttttctttttttctttttttttgagatggagcttggctcactgcaacctccacctcccgggttcaagcaattctcctgcctcagcctcccaagtggctgggattacaggcctgcaccaccatacccagctcatttcttacctatcactttaaactggaaatggcactgttacttgaaagtgtctcccctcctaccttccaacaccccacactttcctggttctatttctaccatctaataattgtattagtctgttcttgcattgctataaagaaatacctgagactgggtaacttataaagaaaagagatttaattggctcatggttctgcaggctgtacaaaaagcataacggcttctggggaggcctcaggaaacttccaatccatggcagaaggcaaagaggaagaaggaagaaatttttttttttttttagacggagtttcactcttgtcacccaggctagagtgcaagggcacgatctcggctcattgcaacctccgcctcctgggttcaagtgattcctgattctcctgcctcagcctcctgagtagctgggattacaggtgtgcaccaccatgccccgctaatttttgtattttagtagaaatggggtttcaccatgtt[136 bp omitted]tgtcacacaggctggagtgcagtggtgtgatcttggctcactgcagtctcaacctcctgggctcaagtgatcctcctgcctcagcccctcaagtagctgggattatagacatgcaccaccatgcccagctaatttttgtttgtttgtttgtagagacaggatttcaccatgttgcccagtctgctcaaattcctgggctcaagctgtccacctgcttcagcttcccaaagtgctgggattacaggcatgagccactgcgcccggacagcaggcacatcttacatggccagagcaggaggaattggggcacaggtgccacacactcttaaacaaccagatctcatgagaactcactatggcgatgacagcaccaagggaggatggtgttaaatcatgagaaaccacccccatgatccaatcccctcccaccaggccccacctccaacactggggattacaattcaacatgagatttgggtggagacacagatccaaaccatatcaggaatttactctgcaaccttcatagcatattggtgttccctcaaactctgtacttggtgcttctctcaaactgtgctccttcttagctatccaatttattctggtggtttcagctagtactggaatgatcttaccccccaaaccttggcctctgctagccttctctcttgagctccagctggacatctctgtcagtatgttccataaacactccaaagtctatctcagtttttcttccatgaactcattgtctctcctgttttgctaatgtctatacatggctccagcctcatcccagctgttcatgcagttatcctgggagcaatactgtctccctttctcccacagaacagcacttctgtatcatttataagtataaatatattttgtttctttgttttgagacagggtctctctgtcgcccaggctggagtgcagtgacgcaatctcagctcactgcaacctccacctcccgggttcaagtgattctcctgcctcaggctcccaagtagctgggatggcaggcacctgccaccatgcccggctaatttttttttttttgtatttttagtagagatagggtttcaccatgttggccaggctggtctcgaactcctgacctcaagtgatccgcctgcctcggcctcccaaagtgctacgatcataggcatgagccaccatgcccagccagcttctttttttttttttgagacggagtcttgctctgttgcccgagctggagtgcagtggtgtgatcttggctcactgcaacctccgcctcctgggttcaagtgattctcctgcctccgcctcctgagtagctgggactacagatgtgcaccaccacacccagctaatttttgtatttttagtagagatggggttcaccccatctct[140 bp omitted]cacatagtgtttgttttttcattggttttccagaaatatgcttactgaggcacatagtgttaactcaggagtgcagtgatctttttttcatgcattaataaattaacacagtaacagagctgttccaggtaccccccaccccaaaagtatatcaagcgagacacaaaatcaggtatccagtgtagctctatttagtcaactttcaacagggctccattgagaagattagttcctgcacatctttttcatgcatcccattctgatcattggagattgttattacaggggtccgtgtcattcgaggatgtggctgtggatttcacccgacaggagtggcacagactggaccctgctcagaggaccatgcacaaggatgtgatgctggagacctacagcaacctggcatctgtgggtgaggatgattgtccgtgtaactcctgagagcgtgtgtttcctttcttggttgctgtaacatgtgcagccttgcgagggtttaatgatattaagagtcacagatgagtaatcagtttagggcaccagaaaaaatgtgtgcgttcttacttccccaatgaaaggtttaaatgggcccccttccttgtgcagctcatgaagatgcaccttcctcctccatcagaggccctagagctcagacaacttggcccacgtcctgtgccatttcccattaacaggcctctgcgtggccaaaccagagatgatcttcaagttggagcgaggagaagagctgtggatattagaggaggaatcctcaggccatggttactcaggtaagtactgggcaagaactggacatatggaaaataggggaaataagagcccaggaattcaggtcaaagggtatgcttgtgcaacactttctaggaatctctttttagagttcctagctctttgaaaataaggacggaaggtctacatgcttcagataccaaagtcacacatcttaatatcacactcaaacttcagtgctttctccggttttatcttgattttttttttttttgatggagtctcactctgtcatccaggctggagtgcagtggtgcgatctcagctcaccacaacctccacctcccgggctcaagcgattctcctgcctcagcatcctgagcagctgggattacaggtgcgtgccaccacgcctggctaatttttgtacttttagtagagacagggtttcaccatgttggccaggttggtcacgaactcctgacctcaagtgatctgcctgccttggcctctcaaagtgctgggattacaggtgtgagccaccgcacctagcctttatcttgatttttaagttatttaccactcttatttatctctgcctcatcttaaacatttattcttttatttttttgagacagagtgtctctctgttgctcaggctcgagtgcagtggtgcaatcatggctcaacctcaacttaaaacctcacctgcccggtttaaacgacctttccagggcaacctccctagtagctgggactacaggcacgcaccaccatacctggctgatttttgtattattattattttttttttgtagagacagaatctcactatgttgcccaggctggtcttgaactcctgggctcaagtgatccacctgccatggcctcccgaagtgctagggtcagaggtatgagccaccacacctggcaacatttattctttcttccctccattgccttggatgctttctgttatcaggcattcattcatatattcatttagtcatccatgaaactttaaatgagtatcagttatatgctgtgtatgttctaggtgtgggaaactggtagtgaataaaataatatctctgttctcttggagcttacaatatagtgggggaaagtgaccagaaacaaacaaatacatcatatgtttgatggtgaaaagaaaatcagtgcaaggtaagaaggatagatactgatttttaggaaatagagggttttttgtttgtttgttttttgatggagtctcactctgtcgcccagactggagtacagtggtgcgatctcagctcactgtaacctccacctcctgggttcaagtgattctcttgcctcagcctcccgagtagctgggattacaggcgggcaccattatggccagctaatttttgtatttttagtagagatggagttttgccatgttgggcaggctgatctcaaactcctgacctcaagtgatccgcctgccttggcctcccaaagtgctgggattacaagcgtgagccactgtgcctggctggaatagagttttaaaggttgtgttaaggagtttaattttatactgtgacaagagaagccagtttgggattttacataaaagagtgacatgctgtgatttatttttaaaggatctctctcactgctgtgtggcaatggttctgttggggataatgccctcaggcatgataatgaccttcttcaccatcagaagattcaaacattggatcaaaatgttgaatataatggatgcaggaaagccttccatgagaaaacaggctttgttagacgtaaaagaacacccagaggagataaaaactttgaatgtcatgaatgtgggaaagcttactgtaggaagtcaaaccttgttgaacatctgagaatacacacaggagagagaccctatgaatgcggtgaatgtgcaaaaaccttcagtgcaagatcatacctcattgctcatcagaaaactcacacaggggagaggccctttgaatgtaatgaatgtgggaaatcttttggcaggaagtcacaactcatcctacatacaagaacacacactggagagagaccctatgaatgtactgaatgtgggaaaaccttttctgagaaggcaaccctcacgattcatcagagaactcacacaggggagaaaccctatgaatgtagtgaatgtgggaaaacatttcgtgtaaagatatcccttacccaacaccacagaactcatacaggggagaaaccttatgaatgtggggagtgtgggaaaaacttccgtgcaaagaaatccctaaatcagcatcaaagaattcacacaggtgagaaaccctatgagtgtggtgaatgtgggaaattcttccgaatgaagatgactctcaataatcatcaaagaactcacacaggtgaaaagccctatcagtgtaatgaatgtgggaaatctttcagggtgcactcatctcttgggatccatcagagaattcacacaggagagaaaccttacgaatgtaatgagtgtggtaatgctttctatgtgaaagcacgcctaattgaacatcagaggatgcattcaggagagaaaccctacgaatgtagtgaatgtgggaaaatcttcagtatgaagaaatccctttgtcaacaccggagaactcacacaggagagaaaccttatgaatgtagtgaatgtggaaatgccttctatgtgaaagtacgcctcattgaacatcagcgaattcacacaggagagagaccctttgagtgtcaagaatgtgggaaagctttctgccggaaagcacacctcacagaacatcagagaactcacataggctggtcctggcgttgtacaatgaagaaagcctctcactgaagacttccctcaccattggatcaagctccttgggggcatatgatcaccagggcacacagtgtgcctgtgaaaatttggcacctacatttgtatcaaagtatgtcctgatccccttaggggatagctcattgtttttattcagatttccctaattagtggtgtgtgaacatcttatctgttgattggctatttgggttttttcttctgtgcattgactgttcatgtcctctgctcattgttttcaaatgggctgttcatctcttgctttttggtttaaatgttgttttttaacatatgagaatataaaaatcctttttttttcagtcatatgtgttgcaaatatcttctcccagactgtcgttggttttttaaattttgccatctgttttcttctgctgaagttttatattttatttatttattttttatttttttgagatggagtctcactctgtcacccaggctggagtgcaatggcatgacctcagctcatttcaaccttcgcctcccgggttcaagcgattctcctgcctcagtctcccaagtagctgggattacaggtgtgcaccaccatgcctggctaatttttgtatttttagtaaagacggggtttcaccatgttggccaggctggtctctaactcctgacctcaggtgatccacctgcctcggcctccaaaagtgttgggattacaggtgtgagccaccgtgcccggctaaagttttatattttaatattatcagtttcaaggtgataatattcacctatactttcctctaaaggttttcctttcaacatttagaattttaatctcctgtgagatttttttgttatagcatgaagtgtgcaatacatactactatattgtctttatataattttacataaatgggctcacactgtatttaaagttctgcagcttgcttttttcatgtaatgttacctttccaagatctgtccttgttgataagtataggtctggctagtcatttatctctccattcccctagtaaaagacatttgtatctttttcgagtttagtgtctaaatctagaagtggaactgatgggtcataggatttaggcaatgtgctggttattaagctattgtgtccgagctccaaacccacccttcttgactgtgctttgtgactttacaaaccacattttggctttgtcaactgctccctgttgggccttgccaataagagatactagatataaactttggggctggagagggaagaagggacttgctccttttttttctattcctattagcttcctggtcattggagtgtccgctcagcattgcttcttcactcagacaccagcagttccttgtcacagcagcagtttaatctagtttgcagctttccagcactcacagatggtagcccatcccctctgagacacaagcatcagctggctggtgtcacctccttagagatgtgaattctagtcacatgggacccctcctcccccttctaagttttagtaatttcaatttatggttgggtgcagtggatcatgcctgtaatcccaacactttgggaggccaaggtgggtggattgctggagcccaggagtcaagaccagcctgggaaatatggtgaaactctacctctacaaaaaaaattcaaaaatcagctaggcatgggaccacacctgtggtcccaggtacttgggagtctgagactggaggttgaagctgcagtaagccatgattgtgccactgcactccagcctgggcaacagagcaagaccctgtctcccaaaaaattgtcaacttcttccctttgttattccagcccagctgttttctgcagttgctacctccctgataacttgaatgttctctgtctcttcagttatttggtttacaacctcataactagttaaaattatttataagttctctctgttaaaataactagtgtggtttttgtctcctagttgggctctgattgatacagaaggttttttaactttattaagtattgacatttcccttccaaattgtattaatttatactcccatgagcagtttgagaaagttttcattttgccattcagcagcacttattatcagtcctttaaattattgccaatctgtaaggtctgaaatggctttgagccttggcttccatgaatgtggtttgtctttctttcttttgttcttttcttttctttctctctctctctcttttcttttcttttttatttttattttttgagatggagtttcactcttgttgcccaggctggagtgcaatggcgtgatctcggctcactgcaacctccgcctcccgggatggagcaattctcatgcctcagcctcccgagtagctgggattacagacacgcatgaccacacccagctaatttttgtacttttagtagagacggggtttcaccatg[133 bp omitted]ccatgctggagtgcagttgtgcaatcttggctcactgcaacctctccttcctggttcaagtgattctcgtacctcagccttccgagtagctgggactataggtgcacacaaccacgaccacctaatttttgtatttttaatagagatagggttttgctatgttggccaggctggtctcgaactcctgacctcaagtgatctgcctgcctcggcttcccaaagtgttgggattgcaggagtgagccactgcacctggcctgtctttattttttaactcatctttcctatccttcaatagtattttgtggttttctccaagaaattgtctatgaaagttaattttttaatagcagttttgcatttatacaggtatacatatatatatttcaaaatataatgatgttgtggggtttatatatatacttacatataatatttgtgtctctctctcatacacagacacatctccccacacaacatttttgtttgatgtgggcagttttaatttcattttacccaaatatttaccaccttggttgcacttcattactttctgcgtttcatccaggatcattttcttctttgcctgaaaaatactccatagagtatcctttagtaagagtctgttgctggtgagcctctcagttttgtctaaaaatgtttttcattgtaccttttgtcactggctggggccggcatcacgggtggtaaaagaatttaccaagacagtcatgaattaaagaaaccaagtctattagagggaaagtaggttgcaaggaggcaatgggcagcacagcagagaaaggggctgtctgcaaagaggcaagagctggagggaagttgtatagggttgtgctggagggactatgtgaggaatgagtttgtgctgctggggctttgcacagaacaaggtatttgggaacaggttgttgtgccagcaggttgtttgtgattagtcgtctctcagaacaatggttcttccccaccttcttgcttatttatctcatcgggactccacacttttttacaagtaaaagtgaatcctttaccttaaatatttggtagcactatgtcacagtaaactgataaaaaattaagtacttgactgggcacagtggctcacacctgtaatcccagcactttgggaggccaaggcgggtggatcacttgagatcaggagtttgagaccagcctggccaccatggtaaaaccccgtctctagtaaaaattagctgggtttggtggtgcatgcctgtaatgccagctactcgggaggctgaggcaggaggatcacttgaacccgggaggtggaggttgcagtgagctgggatggtgccactgcactccaacctgggcgacacagcaagactccatctcaaaaaaaaattaaaaaattaagtacttttttacttttttcctgagtgtcctttaatgattatcgtcatccaaggtatttgaattactcatcagataccccacaatacagcatatatttgaatatatataaaatacactttgtgttttctgtgcagtatgccctcactctattaagtattaattaagtatatcaagatgccatttcatcaatacttccgatctgtagctcaccacccccccgccttttttttctttttgagatggagttttgctcttgttgccctggttggagtgcaatggcatgatctctgctcactgcaacctctgcctctcaggttcaggtgattctcctgtctcagcctcctgagtagctgggattacaggcatgtgccgccacacccagctaaatgttttgtcttttaagtagagacagagtttcaccatgttggtcaggctggtctcgaactcctgacctcagatgatccacccgcgtcggcctcccaaagtgccaggatcacaggcgtgagccaccgcacccagctgatgtttttaaatttttattatggaatatgccaaccataaataagataatttatagtgacacaaaacagaatagttgttgcctctggggtgaaaattgacttgaaaggggtaggagggaacttactggggcgatggaaatactccatatcttcactggagtgtgaatgcaatagtcatcaagtgggtaaacttaaggtttatttgttttattgtatataaattatatctcaattgaaatgtgaaaacaaagcaataaaacatcccctgttcccatttcaggagtcatgtctgggctgcctgggaggacaacaggaatactgatcgctagagcaaataaaagactcttggcagtgggcaacttggtcctcctaaggctttagaaattgtcttgctccatgaaaatgacatgttctgaggccccagtctggggtatactgactttcattagctaacgtcaccatccgtggtgctccctcacttgccaacactgcactgtagatttgactcccaagagcctaaggatagtctctgccaatcctccagtagccaccatcatagtagtttttacccccatcagtcagcagtccagtgtctactaacccctccattaattcacagcagttcttaccacccctttaagccagagcacgatgtgtgatcacccattagctcacatcatatcttatcacctaccttcaaccccagcttagtgtctgatggtcttccattaagtcagtatcatgtcttacttccctcctttagacttagcatggtgacagctgactcccattagctcacagccctgtgttttgtcttcctgttgacctaatgtagtgtctgttgactccatgttagcttcaccattttgtttgctaattccccattggctacagcctcccaagtagctgggactacaggcatgtgccaccaggcctggctaatttttaaatttctttgtagagacaggatcttgctatgttgcccaggctggtctcaaattcctggactcgagatcctcctgcctcagccactcaaagtgttgggattacaagtgtgaaccaccatgctaggcctgtctgctgattttttttattagctgtgggtacagtgtctttgccacatgagcacacagcacagtgggctcagcacagcacaatggcacccaatggctgttccccaattagctaccaatatgatgactttggtcctcttgggcctcagcacagtgtctccagaactcgcatgaccatgtcactgtcttttgatcccccattaccaggttgcaagatttttaagcttgaggacccagtggtgtctgcttccccaaaaatagcccctaatggtgtatcaactgcccatgtattacagcccatgagtatatctgctgaccatacatgaatgtcttctgatttactttccaccagcacagagaatgtcttctgatttacttgccaccagcacagatgccctgcttttggacccatcaccatatttttgtccttaccatagttcaatcattgtgtctgctgaatccccccattagccactagtattgtgtcattggcccactgaggccttggtggagtctgctgaccccagattagcccttatcactgtttgttgctcctccattagccaacagtacagtttcctcagcacccatgaggccccaacaatgtctttgctgacccaactttagcaactctcactctactgatccccacttagtcataagaacagagactttaacctccatgaactcccagtacagtgtctgccgattccacattagctttggctttctggtcacccattggccatgaatacagtggctttggctctcataagacccaatcacagtgtttgctgaccctgtattgactgccttcactgcctggtgatcctccatcaaccatgcatagaatgtctttgaatgcaatgatgccccatcacagcacacgctgtcctgcattgcagcccatcactgtctgctaatctgattatatgagcctcaacactgtgtctgccgactactagacaccactatggagtctgcctcatgtttctcaatcacagtatctgccaaccctatattagtgtcaccactgtgtctgctaatctttttttttttagatggaatttcactcttgttgcccaggctagagggcaatggtgcaatctcggctcactccaatctccacctcccggattcaagcagttttcctgcctcagcctccccagtagctgggattacaggcacccgccatcatgcccagctatgtgtctgctaatcttggtcacaagtacagtgtcttcaatcttcataaaaaatcagcctgtctgctctccccacattagcccttagtcactctgctgattagccaccactaaagtggttttgtctccatcgtggtattagccccatccctgccacactgatgtgtcattgtcccttagtacagtgtgctgacctcatgagccctggcataatgcctggggttcattagagcctacccttcattttcatgaagggtacaacatggtttcagatgatcctgtattagctaccggtacagtgtctttaaccttcatgagttcccacagccatgtctgctgatgctatcatagctcccaacactgtgtctgttgaatcctcattggtcatcaacatagtggctttgatctctgtgatgacaccatacagtttctgattaccctctatgaggtgcagttattgttccctgatctccgtacactggtttgttgactgttctttcaatctcagcaatgtttccttcaatctcagcaatgtttccttcaactctggcagttccccaggccttcaggctgttttcttatttttctgactgtttatttagcatcagggattgtcccttggtctttttggctgtggagtcttatccccttttcctctgtcttccaaatgcgaggactgtttgtggtctccagatgttcaacaatcctgctgttcctcaaggccagacacttttcctttaagcctccggctgtttgtttatttctctggctgtttccaaggtagttctcactgttgcatgacatgtggtgacaatttcctcttctgtttgactattgtagagtctttgcctgtcccaactacaaggactgtactcgggctgttcatgtcactgcaagactctttctcagtccccgtggctgttttctagtgtcctggcatgttcactcagcccttggctattgtctggaaccagactgttcgagctgcttctagtgactccccagtgcctagaataggctaccttaccctccctcttgctacctcaatcctgggtatgttcatacttcctcttgcctcttttctggtctcctactgtttctccatcccaaggactgttgcataccctggatgcagctggggggcattaaacagcaagtgggaatggcaggctgcagggggagcaccttccttccaggtagacctctttagctgtggatgccctggggaaacagtccctgcagagacgctgcctgcttcagagccctggtgtggcctcctggcaggatatctatagcccaagagtcactagatttgcttccatcaccctgctagaaaattcattaaagtgaacacctcccagcattaggggtgtctgtgtgtgaatctctgtttgggagagactgtgacggccgagaggaagcacatggagatcacagtggtgtgtggtgtgcagcatggggaccagtcctgctcttgcccgagcctcattccttctccctaatacatggcatcacagttccagcccagaatccttcagaagtccatgctgatgttggaggatgaatatagggtgtctgccccatgggtgttttttagttcacaacatgaaacccttataataacttaatgtgcaatattactaacagcctttagtttctagacaggcagtgtagtgtaatggctaagaacatgaatgctggagccagatattcattcaaatcctgtgccttaatggtttcttaggtatgggacaaaaagcacacataaagaacacttaaactttgcttaaaaaaaaaaaaaccataaataacccaactaaaaaatgggcaaaggctgggtggagtggctcatgcctgtaatcccagcactctgggaggccaaggtgggtggaacttgaggtcaggagttcgagaccagactggccaacatggtgaaaccccgtctctattaaaaatacaaaaattagacaggcgtggtggcatggacctgtaatcccagctactcaggaaactgaggcaggagaatcaattggacccaggagacagagattgcagtgagctattgtgccactgcactccagcctggctgacagagtgagactccatctcaaataaataaataactataaataaaaatggacaaaggactcaaatagacatttctccatggatgatatacaaatgcccaataagcccacaaaaaactgctcaacgtaattagccatcaggtaaatggaaatcaaaaccacaataacactacacacccatagggtggctagaatccaaaagacagataacaacaagtgttggagaggatgtggacaaattggaaccttctacattgctggtaggatgtaaaatagtgcggctgttttgtaaaacagcttgacaatttctgaaaatgttaaaaataaatgtaccatgtgatccagcaattccatccttaggtatctatgtgggagaaatgccaacatatgtccacacaaaaacctgaatacagatgttcacagcagtgctattcctacttgccaaaaagtggaaacaacccaaatgtccatcaactgatgaaatgatacacaaaatgtggtatgttcataaaatgaaatattaatcagtaataaaaagaaatgaggtgctgatacattctgccaatgtggatgaattttgaaaacatgttaaatgaagaagcctgttgggaaagaccacatattgtataattccatttatatgaaatgtccagagtaggcaaaactggggaaacaaaaagtagattagtggttgtctaggactcgggtgggggtaggtggtagaaatggagtgactgctcacaggtactgggtttctcttgggggtgatgaaaatattctaaaattctattgtgatggttgcacaactctgaatgtactaaagctaatttaattgtgatgttaaatggatgaattgtactgtacgtgtgtgaattacatctcaataaagtttaaaaaataggaaattataaaaataaagatttgaactaggtcagtattttttaaagttgagtctttgtaatattatctttaagaaaaaaatttatttatttatttgtttacttttatttttaatttttgggatgaagtcttgctctgtcgctcaggctggagtgcagaggcgcgatctcggcccactgcaacctccgcctcctgggttcaagtgattctgtctcagcctccctagtagctgggattacaggcacacgccaccactccttgctaatttttgtatttttttagtagagacggggtttc[132 bp omitted]gctcatgcctgtaatcccagcactttgggaggccaaggtgggcggatcacgaggtcaagagatcgagaccatcctggctaacatggtgcaaccccgtctctactaaaagtacataattagccgggtgaaactccatctcaaaaaaaaaaatataataattagccaggcatggtggcatatgcctgtaatcccaggtactcaagaggctgaggcaggagaatcgcttgaacccgggaggcggaggttgcagtgagccgagatcacgccactgtactccagcctggcgacagagcgagactccgtctcaaaaaaaaaaaaaagaaaagaaaaaatttaattagtgcctgcataaaactttagggaaaaacatttctgtttctgccttgtcttagctatgtgtccctggggaaatcatatttaccgctctatgcctcagtttctgcatctgtaaaatggggataaaaataatgcctaaatctgagggacaatgaagtcataaatgtacagtgcttagaataatgctaggcacatatccagctctctgtattagttatattagtagtagtaatggcaaatataatttaatttatgacttagtagtgatacattttagtaatggcaacttatgatatttgtagcaataattttattcacactgacaagtttaactcaatgattttgagaatctctcccaaagatgtcacaaatataatatgttcatttgtaatgttttctttctttttttttttttttgagacagagtctggctctgtcgtccaggctggagtgcagtagcgcgatcttggctcactgcaaccttcacctcctgagtagctgggattacaggcatacgccaccatgcccggctaattattgtatttttttttttaattttttgagacagagtttcgctcttgttgcctaggctggagtgcaatggcgcaatctcggctcactgcaacctcagcctcctgggttcaagtgattctcctgcctcagcctcccaagtagctgggattacaggcatgcaccaccacgcctggctgattttgtatttttagtagagacggggtttctccatgttggtcaggctggtctcgaactcctgacctcaggtgatccgcccacttcagcctcccaaagtgttgggattacaggtgtgagccaccacgcctggcctaatttttgtatttttagtagagatggggttttgccatgttgtccacgttggtgttggactcctggcctcaagtgatctgcctgctttggcctcccaaaattctgggattacaggcgtgagccaccaggcccggcctgtaatgttttcattcttattatgatgcttgtacgctaatttttagtatgaacatctccccactgacaagtagcgacatttcaaagacttctgagcacagtttctcccgatgataatgtgcctgttttcacattctaaagtgttgggggttaggacttcaatgcatcttttggggagacacaattcaacccataacagttcctcagtatgcagtcctcacttgataaatctccaggtttaaaaatctctactgggctgggcacagtctaatgccaccactttgggaggccaaggtgggaagattgcttgaggcgaggagttggaaaccagcctgggcaatagggagatacccatctctacaaaaagtagataaataaagatctgtactattgccaactattgccaagacgataacttgcaaatccctaagcccttggtaaacaattctcttaaagagccccctctcctcagtgtgacatatgtcctcttttacaaatacccaactggcaaatactaactgtattagttttccttaccttttctttttctttcttttcttttcttcctttttttctctctttctttctttcttctttctttctctttctttccttccttctttttttttgagacagagtctcattctgtcacccaggctggagtgcggtggcacaatctcagctcactgccacctctgcctcccaggttcaagcgattctcatgtctcagcctcccccgtagctgggattacaggtgcgccaccacgcctggctaatttttgtatttttagtagatatggggttttgccatgttgaccaggctggtctcaaactcctggcctcaagtgatccgccctccttggcctcccaaagtgctaggattacaggcataagccaccttgcctgaccagctgtattagttttctattgatgtataacaaattaccacaaacttagcagcttaaaacaatacccatttattatctcacagttctgtaggtcagaagtcctggcaggttgtattgggttctctccctaatggtctcacaaggccaaggtcaaagcatttgctacgctggactcttatctggaggttctcagaaaggacccacttttaaccttgttcaggttattggcagacttcagctccttgcagtatgtaggactgatgtccccatttcctcgctggctgtcagccagtggctgttttctgctcctagagggtgactgaatttctcaccgtgtgggcctcttcatcttcgaagccagctaggacgtgtcaaatgcttctcatgtttccaatctctctgatttcctcttctgccaccagcaggagaaaattctgcttttatgatgggctaatgtgcttagattaggctcatctgaatagtctccctattttaaggtcaactgatgagcaaccttagttatatctgcaagatcccttttttatataatgtaatataaccacaagtgagatctcatcatattcacagattctacctacaatcaaggagtttatacaggggtgagggatatgggggcacattcttagaattctgcctactgtggccgcttctgagcctttccttttcatgaatatcccaccgacatatccccattgatgaccccctgactggcaaatctcccctttcagagatatctacccattggcaaatctttcattcatgaacctgttgcggaaaaaaaaaatcaccccattcaaaaacatctatcaaaatgtcccattcatgacccctcctaacaaatctccccatttagaaataaacacattgacatatcgcccatagatgacttccactgaaaactcttgttaataaacgcccactggcatatttcttatttgtaatttctttgtttctttctttctttctttcgttctttctcccttccctcttccctcttccccctttccccttcccccgtcccccttcccccttcccttcctttgagatgcagtctcagtctgtcacctaggctggagtgcagtggcgtaatcacagctcactgcagccttgacctcccgaactcaagtgatcctcccgcctcagcctcctagtagaaaacaggacacaattgagaataatctatcaatcaataaactgacccagagctgacacaaatgttaaaattagcagacaaggatattaaaagttattgtacctattgcatatgctcacaaagttagtagagacatgggaaatgtttgtaaaagacccaaatcaactttataagacttctacttctgggaaaatgaggtagatgcgtttttccccgttcctcccactaagtataactaaaaatcctggattgatgtttctaaaacaaacagaagattctgggctgagcgcagtggctcacgcctgtaatccctgcactttgggaggctgaggcaggtggatcacctggggtcaggagtttgagaccagcctggccaacatggcaaaaccccatctctactaaatatacaaaaattagccaggtgtggtggcaggtgcctgtaatcccagatacttaggaggctgagacagggagaatcgcttgaacccgggaggtggaggttgcagtgagccaagatcataccactgcactccagcttgggcaatggagtgagactccatctcaaaaagaataaagtaaaataaaaataaaagtgtggcatttcccccctacctggctcctgctctggctctgtgttgcacctgctcccccttcaccttctggcatgattgtaagtttcctgaggcctccccagaagctgagcagatgccagcaccatgcttcctgtacagcttgcagaactgtgagccaattaaacttctttccttttttttttttttgatggggtcttgctctgtcaccaaggctggagtgctgtggtatgggcacagcttactccagcctcaatctcttgggctcaaggaatcctcctgcctcagcctgtcaagtagctgggattacaggcatgcaccagcacgacctggctaatgtttgtgtttttttgtagagacagggttttgccatgttgcccaggctggtcttgaactcctgagctcaagcaatctgccagccttggccttccaaagtgctgggattacaggcatgagccaccatgcccagcttaaacttcttttctttataaattacccagtctcaggtgtttccttatagcaatgcaagaaaggcctaacacacagattcttgggggtggtatcttcctccttttttttttgagatggagtttcgctcttgttgcccaggctggagtgcaatggcacaatctcggctcactggaacctccaccccccgggttcaagcgattctcctgcctcagtctcccaagtagctgagattacaggtatgtgccaccacatccagctaattctgtattattattattattattatttttgagatggagtcttgctctgttgcccaggctggagtgcagtggcatgacctcagctcactgcaacctctgcctcccgggttcaagcaattctctgcctcagcctcccgagtagctgggattacaggcacctgccaccatgcccagctaatttttgttagacggggtttcacc[139 bp omitted]tgtcaggctggtctcaaactcctgacctcaagtgatccacccaccttggtctcccaaagtggtgggattacaggcatgagacactgcacctggccatcctcttctttctatcttttaaaaaaataatatatatgtgtgtatatatatgtatatatgtatatgtatatatgtatatatagtatatatgtgtatacatgtatgtatatatgtatatatgtgtgtatatatgtatatatgtgtgtatatatgtatatatacgtgtgtacatatatgtttaattaactgaatgcttgccacaatcttcgtcttataaggacatcagtcctattggattagggctccacccttttaacctaatttaaccctaattatctccttctctttcagtcacattgagggttagggcttcaacatatgaa[221 bp omitted]gagaaaggagaatcgcttgaacccgggaggcagagtttgtggtaagacaatatcacgctgttgcactccagcctgggtgacagagccaaactccgtctcaaaaacaaaacaaaacaaaacaacacaacaacaaaaaaaaaacaaaagaaaaacacaaacaaaaaaactgggggcaataaaggcatgaagggctaatgtacacaccttcacaattgtgtgctcaccatcaaaatgaggagggccaagggagggtctccaccagatggattcattcactttatagaaggatctggggaagaggaagtcagagtggatgctggtacaatatacagtttcctcccacaacatctcatctttctgtttttccctacctgatgcagtagtctcaggaccagaactgcaactgtagcttccagaagcagggatgagccctaagcaagaaactttaactgtacttttacatgtttatgtcagaattcctaagggcttgatatagtttgaatatttgtccctgcccaaatctgttttttgttttgttttgttttgttttttcagtaga[135 bp omitted]aattgccagtattggaggtggggcctggtggggggtgtttggaccatggaggtggattccttgtgggttggtgctgtcttcaccatagtgagtgagttcccctgagatctggttggtaagtgtgtggcacctccccctgccatgctgtctcttgctctcctgctcccaccagatgagacgcctgctcccgctttgccttctgccatgattggaagcttcctgaagcctccccagaagctgagcagacatcaacaccatgcttcctgtaaagcctgtagaactagaccgggcgccgtggctcacatctgtaatcccagtactttgggaagccaaggttgggcagattccctgaactcaggagttcgcaaccaacctggacaacatggtgagatcccatctgtattaaaaatacaaaaaaatagccaggtgtggtggtgtgcgtctgggtcctaggtatttgagaagctgaggtgggaggatcgcttgaacccggggattggaggttgcagtgagccgagatttcaccactgccctccagcctgggtgacagtgagaccttgtgtcaaaacaaaacaaaagcccacagaattgtgagccaattaaacctcccttctttataaattacgcagtctcatgtatttctttatagcaatgcaagaacagcctaacacagggcctaacatgatagactgcgccttcacctcatctggcaaattagggtaaacagtgaatgcatgcagctgtgttacctagtgattgaggtagcccgctagttccacacctatgtaactataccctacatggatgggggtagaccgaggcagaagcatttgctagactggtattgctgctgataatctagactagcacagaggctgaacctaatgtcccttccaaaggtggaaaagttgggtcaaattcagccataaatggagagaaagaggaatggtacctgagagtaaaagaatgaagaaatgtgttgtgcaataaggaaaagtcattacactgatgccctgaaagaggccgagaacaagaggtgactttatttattggctcaattataccggatatctgaaagaattaagtggccaggcgcggtggctcaagcctgtactcccagcactttgggaggctgaggtgggaggattgcttgaggtcaggagttcaagaccagtctgggaaacctggcaaaaccccattgcttacaaaaattacgaaaattagccaagtatggtggtgcatgcctgtagtccaggttactcaggaggctgaggtgggaggattgcttgagcccaggaggtcgaggctgcagtgagctgagattgagtccactgcactccagcctgggcaacagagcaaaactccatctcaaaaaaaaaaaaaaaaaggccaggcgcagtggctctcgcctgtaatcccagcactttgggaggcggaggtgggtggatcacgaggtcaggagatcaagaccatcctgactaacacggtgaaaccctgtctctactaaaaatacaaaaaatagccgggcgtggtggcgggcacctgtagtcccagctacttgggaggctgaggcaggagaatggtgggaacccgggaggcggagcttgcagtgagctgagattgtgccactgcactccagcctgggtgacagagcgagactccgtctcaaaaaaaaaaaaaaaaaaaaaaaaaaaagaaaagaaaagaaagaaagaaaaaagaatgaaaccacaatgaaaccgtatgttgcgaaaactaacctcaacatttagaacctaacaaggtcgatgcctgtaaacctcagtggcattgctctgggagatgaactggaccaattgttaagggaactccagtaatgtgccagtatcttttgactcttactctgcaggttacatttactaccatagcatgatataatgtaacactggcattgttgctaagattataatgtctatattgatggtcaaacatattggtaaattgagttaaagccttttcaagatataatactaatagaaaatgactgccttgtggaaaaactggttttggctaaccatcagctaatttctatgctaaacagtttttgtttgtttgtttgtttgtttgttttttaagacggagtctcgctctgtcgctcagcctggagtgcaacggcatgatcttggctcactgcaacctccacctcctgggttcaagcgattctcaaacctcaggctcccaagtagctgggattacaggcacatgccaccatgcccggctaattttgtgttttagtagaatttcaccatgttgaccagactggtctcaaactcctgatctcaggtaatctgcccgcctcggcctcccaaagtgctgagattacaggcgtgagccaccacgcccagcctgctaaatagttttgtacaagtttacataagatacaaatag[132 bp omitted]ggcaacatggcacaaccctgtctctactaaaaatacaaagaattagctgggtgtggtagcatgcacctatagtcccagctactctggaggctgaaatgggaggatcacttgagcccgggagacggaggttgcagtgagccgtggctgcaccactgcactccagcctgggtgacagagacactgtctcaaaaaaaaaaaaaaaaaaaaaaattaaaaaaaacccaaaaagcaaacaaaaaataaaattagtacaaaaatatgaagatgtatataatggtttgataggatgaattagttttttactattattatatgtcacataaatgctataccaaaagtagatgcccagacaaatacgatcattttgctgtgaatgagtcttggccaaaggccaggggtcacctgtgtattaaggaatttaactttatctgaagagaggtctggcctttgccatcagattccagttggtaatctctaagcccttggactgttgtgtttgataggagtctgtctctttgtttgcttgggggtcttgggccagtcggattgaagcaatgtgatttagggtaggggatttagcccagccagataatagctatgtgatttagggtaggggcttgacctcctgagggctggaaactgaaatcaaccacgtggacagtcaatttttcctacatgatggagccctggacaccaaggcttgagtgagtttccctgattggtaacactccatgctattgtcacacaacaatgctgagacagtattgctgttgtgattccacagaagaggacaaccggaggctctgcatttattaccttcctggactctgccctgtgtatttcaccccttggctgattttaatctgtatcttttcactgtaataaagtgaaaccatgggtataatggctttcagtgagttctgtgagtccttctagtgaatcattgttttttttattttttatttatttatttattttttttagagagagagtctcccctctgtcgctcaggcgggagtgcagtggcacaatctcagctcatcgcacctctgcctcccgggctcaagcaattctcgtgccccaacctcccgagtagctgggattagaggcgcctgccaccacgccagctaatttttgtatttttagtagacatggagtttc[133 bp omitted]agacctttgagtttgcaattggtgtcagaggtggatacagtcttgtatggtgattattccctctaacttttgcacaagataaactacaaacatccatttattgtccatagactagcaattaacaataagaaattgaacttaaaaatgaataccacacaataaagtggaaatagaacaatatcaagtaaaacagcataaaaaatatgaaatatttaggggataatttgtcaaaatatgtgaaagatgtgtacactgaaaaatacaaaatattactgagagaaattaaagaaatggagagggggctgggcatagtggctctcacctgtaagcccagtgctttggaaggctgaggtgggaggattgcttgaggccaggattttgagaccagcctgggcaatatagtgagatgcccatctccacaaaaaataatttttaaaaaattagccaggtgtagtggcacatgcctgtagtcccagctactctcaaggctgaggcaggagaattgcttgagcccaggagttggaggctgcagtgagctatgatcatgccactgtactccagcctgaatgacagagtgaaactgtctcaaaaacaaacaaacaaacaaacaaacaaacaaacaaacacacaaaaaaaccagaaacagaaaagaaagacatg[153 bp omitted]tctactaaaaataaaaaaaaaattagctggatgtggtcatgtgtgcctgtaatcccagctactcgggaggccgaggcatgagaattgctccatcccgggaggcagaggttgcagtgagctgagattgcaccattgcactccaggctgggcaacaagagtgaaactccgtctcaaaaaaataaaaaaagaaaaaaagaaaaaagaaaactcaatattgttaagatttcaattctggtcaggtgtggtggcctgtaatcctagcattttggaaggccgaggtgggtgaatcacttgaacccaggagtttgagaccaacctgggcgacatggcgaaaccccatctctacaaaaaatacaaaagttagctgggcatggtggttcgcgcctataatcccagctactcaggaggctgtggtggga[133 bp omitted]attcaaaccaatcccaataaaaatcacaacggccttttttttttttttttttgcagaattggataaacttattttacaattcatatggaaatgtaaaggacctacaacagccaacacagctctgactttattaaatttacctacttgtgcaaccgtcactacattcaagttctaaaacatttatatagtcccagtaagatcccttgtgtgtgtgtgttttttttttttgagacagggtctcggtctctcacccaggctggagtgcagtggcacaatcacgattcaccgcagcctcaacctcctgggctccagcagtcctcccacctcagcctcccgagtagccaggacagcagccgtgtatgtatcaccatgcccagctaattaaaaaacatttttttttatagagacagggtcttgctttgttgcccagtctggtcttaaagacctgggctccagtaatcctcccacctcagcctcccaaaacgctgagattttaggcgttaacttctgtgcctggcaccttgtgctaatttacagttaatatccattaattgtaattcccaccttcagacaaccagtaatctacagatctctatagatttttttttcttagacagtcttgctctgtcacccaggctggagtgcagtggcacgatctcggctcactgcaacctccacctcccaggttgaagcaattctcctgcctcagcctcctgagtagctgggattacaggcacacgctaccatgcccggctaatttttgtatttttagttgcttagtatgtttttgcggttcatccctgttgtatttctcaacattttattcctttttcttggtaaatgtaccacattttgtttatccatttgccagttgacaggcttttggattgtctccttttagctagtttgaataatgctgttccgaagattcaagtgcaagtgtttgtgtgaacatttgtcacatttcttttggatagataccttggagtagcactgctgggttgtatatatggtaaatttttgatcaactttctttgctttttgagacagagtctcgctctgtcacccaggctggagtgcagtggcatgatcttggctcactgcaacctctgcctcctgggctcaagcgattctcatgcctcagcctcccaagtagctgggattacaggcacctgccaccacgctcagctaatttttgtattttttagtagagatggggtttcagcatgttggtcaggctggtgttgaactcctgacctcaggtgatccacccaccttggcccccaaagtgctgggattacaggtgtgagccactgggcctggtcaaatttttgatcaattttctaagaagctgccaaacttttccaaagtggctattacattttacattcacagcagaaatgtatgaaggtttcttattctccacatccttgccaacatttcttataactgactttttaattaaagctactttagtgtatatcaagtggtatctcattgtggttttaattggcatttccctaatgacttatgatgctatgcatctcttcatgtgttataggttgttgttgttgttttgaaacgaggtctcactctgtcacccaggctggagtgcagtggctccatcacagcttactgcagcctcgatctcctgggctcaagggatccttttgcctcagcctcccaagtagctgggactacaggcttgtgccatcgagcccagctaatttttaaattagtttgtgtagagccagggtctcgctttgttgcccaggctggtctcgaactcctgggcttgagcaatcctcctgcgtcagcctcccaaagtatcatgtgtttatttgtatattgtctttggtgaaatgtcttttcaatatttttgtccatttaaaaacattttggaattttcttaatttttttttttcaacaataaaatacaaaccattgtaacaaaaagggggatttaaatagtatagaaattggccaagtgcggtggctcatgtctgtaattctggcactttgggaggctgaggcagatggatcatctgaggtcaggagttcgagaccagcctggccaacatggtgaaaccccgtctctactaaaaataccagaattagctgggccttatcgtgcatgcctgtaatcccagctacttgggaggctgaggcaggagaatcgcttgaacccaggaggcggaggttgcagtaagccgagatcacaccactgcactccaacctgggtgacagagtgagactctgtctcaaaataaataaataaataaataaataaataaaataaaataaaataaaacagtataaaaccatataaagagaagcacttccttcctcagtgcacttgcatactcttcccattaacagtctgacatgaccttccagacctttcactgtgcatttatagaaacaaacatcaaaaactgtgtttgctgtgtgtttttacataaatgaggtcttgctgcgcatactattctgtaatttggtttttcctcccggcaatgtttcttcattagtgtcaccgtgcgcccctgccgtatggatgtgccccagtttctcaaccaatacccaagttatgcattcaggatgtttctggttcttctctactacacactaaacactttattttcttattcttctggtataaggtatgccacaccattctcatcttctagtgaccaaggaggagtctcggctcagagaggagtaggacagaccagggtcgctcagcagaaccctagcaggcaggaacctgacccggccagagacatgcctgcttggagctgagcgggtggcgaggcaggcaggggccagcaggagcatctgcctgggacagagtggccgtgaggagtgcgggggcaacctggcacttccctaccctatgcaatccctttgccttcagcatggggacactgacacctacacccaacctcttttgcccatttttaaactgggttgtttgtcttctttttgaattcttttaattagagatgaggtctccctaatgttgcccaggctggtctccatctcctgggctcaagtgattctcctgccttggcctcccaaagtgctgggattacagcgtgagccacggtgcccagcctgagttgtgttctttatacattctggatacaagccctttatcagatacatgatttgccagtgttttctcccagtctgcattttttttttttttttttttttgagacaaggtctcactctgtcacccaggctggagtgcagtggtgtgatcatagcttaatgcagccttgaactcctgggctcaagcgatcctcccgtcttggcttccccgagtgctgggattacaggtgtgagccaccacacctggccacattttgctttaatgtcttctatagaactaggtcctttcaatgttttaggaggttttttcctgtttttgaaaggattcttgacttctgatcttggtgttgatggtagtgagtcattttcatctcgtttgatttttgtgtatttttggctggagtgcctcgtatagatttctccactggggctttttcttcagtttcctcattatgttcaccatcttcatcatcttcctcatcatattcatcttcatcagtagcaagttttagtttatgtggatacttgctgctgcttccaggggcagattgctttccagatagacttagggatttggcatcctcctcttcatctgactcctccacagcttctaagtgctactaatatgcataggccctaaaccacacttcaattgtaagacaatagccagtgttatttccaagcccacaagagaagcttttggctgtacaaacatttgcaaagttgccagtgttactttttttttttttttttagagacagtcttgctctgccgcccagactggagtgcagtggcgcgaccttggctcactgcagtggcatgaccttggctcactacaacctctgactcccaggttcaagcgattctcccacctcagcctcccgaatagctgggattacagtcacccgccactacgcctggctaatttttgtattattagtagagatgggtttcaccatgttggccaggctggtcttgaactcctcacctcaggggatccatctgcctcggccttccaaagtgctgggattacaggcgtgagccattgtgcctggccaaccagtgttacttttaattggactgctttcatatccattgcctctgcttcagcaacgtgcaattcaccctttgcacccgcccctaaactgtcctttctgaaagataactggtgctcattttcatcattatccactttaaagtgatcaatctttgtctgcctttagtttgcaaccaaaaagatacttctgggagctcagggggctcatatccatgtccactgaatcttccatggggtggtggcatgcacttagataggagggaaggtggatggagctaaacgactactgttccagagaacagtcacacagaatcacattggtgcaagctactttgattcaattttgaaggttggccgggtgcacacacctgtaattccagcactttgggaggctgaaacaggtggattgcttgagctcaggaattcagaccagcctggacaacatggtgaaaccctgtctctacaaaaaatacgaaaatcagctgagtgtggttgcatgcgcctgtggtcccagctacttgggaggctgaggtggattacttgaacccaggaggttgaggctgcagtaagcctagtgatcaccccactgcactccagcctgagcaacagaaggagatcctgtctcaaaaaaaaaaattcaaacggccttgagtcactggagtaaaccccacttggtcatgatgtataattctcgataggttgctaaatttaatttgctatatagttttctcgtgatgtgtttgtttggcttacatctcagaggtctcttaggtctcaatactggcttcatagggttggagagtgttcatgcctcctctatcttctgaaagattttgtagagtgttggtattatttctcctgtaaatgtttaataaaattaatcagttaaactatctggctttgggtttttcttgtgtgaacagattttaacttacttattacaactcttttcatattttctttctttctgtcttttttttttattttctgagatggagtctcgctctgttgctaggctggtgtgcagtggcgagatctcggctcactgcaacctctgcctcccaggttcaagcgattctcctgcctcagcctcccgagtagtggggattacaggcgcccaccaccacgcccagctaatttttagtagagacggggtttcaccatgttggccaggatggtttcaatctcctgaccttgtgatctgcccacctcagcctcccaaagtgctgggattacaggcatgagccaccgtgcctggctctattcatattttctatgacttcttgagtcagttttgataattggtgcacttttacaaatttgcccattttgtccaagttgtctaatttattagcataaagtttttatagaagtatcttgtcatccttttcctttctgtagggtcagtggtcttgcctcctaattttggtgatgtgtcttctctcttcttggtccatctaaatatttgtcaattgtgttgatcttttcaaagaatcaacttttggtttcacgaattttctttattgttttttaaatttatccattgcaatgatttccatccaaatctttatcatttccttacctctgcttgctttaagtgtagattgctacatttctacatttttaaggtgggagcttagattattggtttgaaatctttctccgtttttcttttctttctttttgagatggagtctcgctctgtcacccaggctagagtgcagtggcacaatctcagctcactgcaacttctgcctcccgggctctagcgatcctcccgcttcagcatcccaagtagctgggactacaggcacgtgccaccacacctggctaatttttatagagacggggttttgccattcttgccaggctcatctcgaactcctgagcaatctgcccgccttgacctcccaaagtcctgggattacaggcacgagctaccgtgccaccctctccttttcgaatataggcatttaaagctatacatttccctttaagtactgctttagtcgcatcccataaattgtggtatgttgtgttttcattttcatgcattactttctaatttcccattcatggcttatttagaaatgtgttaatttctggccgggcccggtggctgtctgtaatcccagctacttgggaggccgaggcgggtggatcacctgagatctggagttcgagaccagcctggccaacatggtgaaacctcgtctctaataaaaatacaaaaataagccaggtgtggtggcaggcgcctgtaatcccggttactcaggaggctgggcaggagaattgcttgagcccaggtggtggaggttgcagtgagctgggatcatgccactgcactccagcctggccgatggagcgacactctgtctcaaaaacaaaaaacaaaacaaaacaaaacaaaatgtgttaatttctaaatatttgtgggtttgtccaatttccttctcttgtggatttctagttgttatagtcagaaaacatattttgtagaatttaagccctttaaaatgttttgaaacatgttttatggtctagcatagatctatcctggagtgtgttccatatgtatttgaaaataatgtgtattctgctgtcgttgagtgcagtgttctattggtgtcaattaggtcacatcaggtttatagtgttgttcaagtcttccatatccttgatgattttatttctagttgttctattaattcctgagaatgggttattgaattctccaactgctatttctgaattgtctatttttccctttgtttctgtcagttttttgctccgtgtgtttcgaggctcctttgttagatatatatatatatagttttataaatatatattatatttttaataaaatatacattgatatacaattttataaatttatataaaattaaaaaaatatttttctgatgaattgaccatagtatcattataaaatgacccttttgtgtttagtaacattttccaactaaatttctattttgccagaaatcagtatagccactccagctcatttatgttactctttgcatgttagatatttttccatcattttactttcagcgtatttgtaactttgaatctaaagtgtggcttttacaggtagcatatggttggatcctgtcttcatcctaatatgacagtctctgccttttgattggggaatttagtccatttatttcgaatataattattgatatggatagatttacatctgccattttgagatttgttttccttagctctcatatctttttgttctttctctttctctctttttttttttttggtgaactagatattttatttttttttattttttatttttgagacagtgtcttgctctgtagcacaggctagagtgcagtgacactatcatggcttactgcagtctccaattcctgggctcaagcgatccttttgcttcagcctcctgattagctgggaccacaggcatgtaccaccacacgtggctatttaatatataaagacaccaagtctttaactattaaatgcaacatgtggacatcctcagagacagtttctagtggactggtatttttttttcccctgtgtatggaccagaattctctgtgtgtgcagtttgtttgttttgcatgtctcataattgttaaaaagttgacactgtagataatatatattttagtaattctggattatgaccccaccctccacagttattattgttgctgttgttttttgtttgtttagggactcatggggactaattctgtagagtttttcatccctcagtgtgcagttactgatgtctctgcttagtttttttttttgagatggagtttcactcttgttgcccaggctggagtgcagtggtgcgatttcagctcactgcaacctccacctcccaggttcaagcgattctcctgcctcagcctcccaagtagctagaattacaggcatgcgctaccacacctggctaattttatatttttagtagagatggggttttaccatgttggccaggctggtcttgaactcctgacctcaggtgatcctcctgcctcagcctcccaaagtgctgggattacaggtgtgagccgccacacctggctgtttagtttttaaataattctttccgtttttatgcctggcttccttggggtcacctgtgggtctgcatagcttatttttatccaatgattgcttagaagttgtgattatacacctcaaaccagtatggcttccactaaggggataactgtgtgagtttgagtacgcatattaagttcggtctgcttgtaagtctgtgctggcattcatttcggcttgtatagggtctcacattcatctaggtacctgatattttgtggtcatgtacacagccttccacatcctcatgcatatgcatggacttatcaattcccactactgctgtcttattttccatatccctttaattttttgtctggtctgctgctcactcaaacaatgttgcagcctcaggcagctgtgaggttggccttccccaattacttgctaccaacattgctgttgtttttgacaatacccctaggcatggagcttttctctggagctcagagtcaggtcagctccctccatttacagtgaggcttccattcctcatggctaccatgcccacagagctgtggatgggagcagctccaagtctaaatgccatagaccccactattcttatcaaggtttggtagtttttgaccatttaaaaaaagcttttgggggaggggttttgatgagctcctcaccctaccattccagaagctccacctctggacaagtgatggtttttcttttttaagagactgggtctcactctgttacccaggctggagtgcagtggtgtggatcatagctccctgcagcctctagctcctgggctcaagcaatcctcccaccccagccttctgagtaactgggactataggcatgcaccactacccctgggtaatttaaaaagaatttttttagagacaggatcttgccatgttgcccaagctggtcttgaactcctggcctcaagtgatccccccatgtcagccttgcaaaacactgggattacagggcatgagccaccatgtctggcctggacaagtgacttttgacaaaagtcaaaatattgagaaagggtagtatttttaaacaaatggtgtggaaacatttgaatatccataagcaaaaacaaaacaaaacaaaacaaaaacataaaagaacttggatccatatttcacaccatataactcaaaatacatgctagatctagatgtaaaacttaaacctttagaagaaaacacaggaaaaaatcattgtaatctttggttaggcaaggatttcttagatacagcactcaaagcacaacccagaaatgaacaaatggaaagaacggacttcatcaaaataagcagttctgttcttcaaaagacactcttaagagaatgaaaagacaatccagagactgggagaaaacctttgcaaggataatggactgatagtgaagttacacccagaatatatttttaaaaactatcagtgctcaacaataaaaaaacccaaataacccaactgataatgggcaaaagatttaaacagacacttcatcaaagattctcaataaaagatgatcaatattattaatcattagggcagtgtaaattaatatcacaatataacttcacatgtactaggatagctataataaaaaagactaataataataagagttggtaaggatgtggagaaaccggaaacctcatacattgatagaatgtaaaatggtgcagtcatgtgaggaacaggcctaggtctcaggtctcagccatcactcatctatcctggggagatactacaatggtttggaggacaagaaaataaaaccgaaaactaaaactgacatatcactatatgcccaccactaatggctatagtaaaaaagatggaaaatgccaaatgttggcaagtatgtggagcactagaactcgcatactgggttggtgggagtgtacattggtacaaccacttgaaaactggttttataacatatagctgaacatatggatacacttaggtacatacctaacaggaatacatacatatgttcaccaatacacagcaacacaattcctaatagcccaagctgcaaacaacccaaatgtctacaaacagtagaatggataaattatattgcagcatattcacagaatgggatacaacatgacaatgaaaatgaattatctacaactatatgcaacatatggatgactctcacatacataatgtgaatgacagaagacagatgctaaagagtatatggctcaattatatgatatataattgactcaatttatataaaatacaaaacaggcaaaatgaatctatgctgtgagaagccaggataatgtatacccttgggggcttgcctggaagggaaagtggggaaggcttctggggtgctggtcatgttctgtttcttgatctgagtatgttcagtttttgagaatgcactgagctgtatgtttatgatatatgcattttctgtatacattatagtttaataaaaagattttaaaataaaataaaaatacaattgcatgctagaaagaaagttcctttttatgagtattgtaaaaaatgtttaagggaaaatgagaacgtgtctatatatcagtgttaaaaaagagcagtgctctttcttgagaagtcttccagttattcaactatgataaactgtaattatgtcttagaataactaattgcaatgcaacatgactttatcacatagcagtctacacaaaactacccttaatgtgcatgtaggaaatgaatataccttaaccaaataggaagaaaaacaaaatattaggaagtgaaactcaatttttcaaccattctttttcaggaaatcccaaggaaagcaggggtgttggtgggttagcctgaaaatctagagtgccgtggatcagttccattgtcgtagggtcagttactgagggaatcaggaatctatggcctgcagcttatgcaaatgacagctttggggacataggttagaaggcatgcatacttcttatagggtatgactcatctgctctcccagcagggaattaataatgagacaactactacctttatatgtctgtatcattcaatgactatatttctgtaacatagcctagagctaggcctaatttctcaattcataaagttatatctttaaatttaaaaattccattgcacttaaaatatatataccatgaggacttcccaagggaaaagaaaaaagtttttcatggaaatcttttctatgtcttaagtgccaatgatcacaaaaacagatatctgcattcccaagtaggttttctgccttgatgtcagtgccctgccagtgtttggacaatgaaaactcttctcctcaacctagaaatttgaaaaagtttttcccagtagtgagtatttttatgtcccaggatatgctgaaccaatcagtactgaatttaaaaagttctttatccaaaaagtgaagcataagagatgacgagtcatctcctcaggtcttaattctactatttccaggagctcaagaggtctgtatgaatcatgtcaccaaacatgactttcgctcaaatgctttctctaaaggctcttcctatgcatagaattgcatatacactgtggtgatgcaggaacttgtctttccagtggactgaaggatacttggctctgtttgccttcagttcactcaagcctcagtctctcatacccatttccccctgtacaatgattgcagcaacaggccttcctcctccctgctattagatacctgatgcatacccagttgtgatttccaggtgaagactttctcagtcactggctttatagcgtttttctccactatgcattttctggtgtttaatgagattcgatctgtcagtaaaggccttctgacattctgtacaagcataaggtttctttcctgtatgaattatctgatgcatacttagtgtggctttctggatgaaagctttcccacatttactacattcatagtgtctttctccagtatgagacttctgatgtatattgaggcgtgacttccaggtgaaggttttcccgcagtcaccacattcatagggtttctccctagtgtggattttctgatgtgttatgagatttgatcggtcagtgaaggcctttccacattcagcacatatattgggcttctcacctgtgtggattttctgatgcacacggagttgtgacttcttagtgaagcatttcccacagtcgctgcattcataaggcttctctccagtatggattctatgatgcgcaatgaagtgcgatttctggataaaggccttcccgcattcaggacaaacgtacggtttctctcctgtatggattctctgatgcacgcttagtgttgatttctggatgaaggctttcccgcagtccttgcattcatagtgtctctctccaatatgagatttctgatgtattttgaggcgcgacttccatatgaaggcttttccacagccattgcacttatagggtttctctccagtgtgagttttctggtgtttaatgagatttgactggtcagtaaaagcctttccacattcagcacacatatagggtttttccccagtatgagttttctgatgtgtggtgaggtttgtcctgtgagtgaagacctttccacattctgtacatatatagggtttctctccggtgtgaattctttgatgcacatggagttgtgacttcttagtgaaggatttcccacagtcactgcattcatacggcttttctccagtatgaattctctgatgtgtgttgaaatgtgatttctggatgaaggccttcccacagtcagcgcatacataaggtttctctcccgtgtggattctctgatgcatcctgagtgctgattttcttgtgaaagccttcccacattcattgcattcatagtgtttctctccggtatgagttttctgatgtatactgaggtctgagttctgggagaagccttttccacattcactgcattcataaggtttttctcctgtatgaattctcagatgtctaaagaggtctgatctctggaaaaaggcttttccacattcactgcatttgtagggtttctgcccggtatgaattttttgatgtgtaatgaggtttgatttgagggtaaagactttcccacattgagtacacagatagggtttttctcctgtataaacacttggatgtacatcaacctggggtttctgggggaagactttgttgcttttgtcacattcacgggacttttctccagcatgaattctctgatgctcaaacagatgtgacttctgagtgaagcccattacacattcagtacacacataaagcttctcctcaggatgaattttctgatggtgggtgggagcttgtttgtggctgagatgtttttcatagtggtcatgttcacaggaatttgctcctgttttagcattctcattcttagtagaggaagggctatgggggaaattgttaccatttccaaaaatcttgccaaggttctttgttgcactgtttctattatgattatgtgagtttaaagtatgcttcaaaattgtgtcacagttatggagtcttttaattgaaggaacaagcttggtagtcacatgaattattttttcaatgtttttatgttcatagcccctctccttaatcaatactttcacatgacttaaaaggttattctggttttcctgacgttgctctagctggtcattatcttgccacagttcttctaaaatagaacataatgaatcttctcctatgggttgatcaaatctctcacagtggaagaaaattcctccaggaattccctgttgctgcattttcccaatagcctcacctaaaaagaaaatgaaagaaatgaaaacgacacaaagaacaatcagcagaggctagaggggacatgtagttcagacaggatgaacacagataaatggaagagcccataggacaatatagtagtaataatgtagcaacacaacattcttatagaacacttaataaatgcaaaacaactgtataccatttatgatgcacagagactgttacaagtgctttacatgaaacagctcatttaactaaccctatgaggtagctaaaccctatgaggtagctacgattatcatttgttttacaatttagaaaacagaggcacagagaagtcatgcaacttgctgaatatcgaatagctaaataagtgggagagatgggatttgaactctgggagtccagctccactatgtaagaggcctggattgtgagtagagtaaccagaagaaactgcagcctgtgaggggaagcttggcatggaagaaatatttcagaatttatgttcttaatacatatcagctccaccactttactaagctctctgcttcttcttgcttttccctctataccattatgagtggagcccttcaaatttaatgttaatttgaacattaaatctatatgcctcaaacaccaattcctttatatctataggaaaactagttgcaacatgccatcctgacatagacaaacagtaaatagacatttgcactccaactttataaccagctgcaagtttctttctttctttctttcttttttttgaaatggagtcttgctctgtcacccaggctggagtgcggtggtgcgatctcggctcactgcaacctccgcctcccgggttcaagtggttcgcctgcttcagcctcccgagtagctgggattacaggcatgcaccaccacgcccagctaatttttgtatttttagtagagacggggttacaccatgttggccaggctggtcttgaactcctgacctcaagtgatctgcccacctcgggctcccaaagtgctggaattacagctgtgagccaccgtgccggccccagctgcagtttctattggttccaggaatacatgcttataacaaggcgtgtaaaagaggaaagggaaagctatctgtggcagaatctgcaggccctcccctgagatctattctccccttcttttacaggaatagaatgtagctgggccttacatccactggcctcgctatgttctcagcagtggaatatgagcagaagtgatatatgctacttgcaggccagccttaagacagtgggcaaatgtcctctatttcctcttccctcttcccactggactacacagtgacccatcattaaccaggcaggtgacaacaatgccccaggagatgccagaggagtgacttagaacatggtccctgaatgacccatcaggattagagttgacttgttgaactggacccattcacctcagaattatcatgtaggggaagacatacatctatatttagcctcttgttttgttcctctgtgcatatccaaaatgtattgtctttctaaatattagctctaattttggtatacctctagggagcttatgtttgctatgaatttgtaaagcagacactgtaccattcatattgatactcagtttggcacagttttataacagaaaggacaaatacacaaagggtgagagtgttaacatttcatgcagtcatcttccctttccaaatataatgtatgttcctttgaattcctctgagcagacacttgaaaatttcatctgaaagaggaaaaatctcctcctctgcctatatccccaaattcaataaattcatttactaaatattttctacatgctccacttcaggaaactgaagaataagtatgctggttatcaatgttttgcctctcagttccaaattcacccttccttgcctgctcaacaaaaacggatctggccccagttaccctgatgtgattattacacatcgtatgctgtatcaaaatatcccatgcaggctgggtgcggtggctcatgtctgtaatcctagcactttgggaggctgaggtgggtggatcacttgaggccaggagtttgagacatggcaaaatcccgtctctactaaagatacaaaacttagctgggcatgttggcatgtgcctgtaatcccagcactttgggaggccaaggcaggcggatcacctgaggtcaggagttagagaccagcctggccaacatggcaaaaccctgtctctactaaaaatacaaaaattagccaggcatggtggcatgcacctgtaatcccagccactcgggaggctgaggcaggagaattgcttgaatccgggaggtggaggttgcagtgagccaagattgcaccactgcactccagcctaggtgacagcgagactctgtctcaaaaataaaaaactccaaaactcccaaatatcccatgtaccccataaatatatatacctatgtacccataaaaattaaaactttaaaaagtggatctcgatctctttaaatatttttttcttctgccagctggcacgatattaaactttgtcagtgtaagatgctagagagacactgcaggatgaggagggtttgcttcctggttctagggggctcactcagcaggctcatccagcaggggcaggctgtctagcaccaggctcatgtagtgtgggcatctttgccaacatctggctcctgacgcacatgtagtgtccccagtacccaggtctcgcggtcttctctagagctcggctcctgcagtgtgggtgacttctccagcacccagctcctgcagctcatatggcttcccaagcacctagttcctgcaggcccccgcagtgctgtacagtcagcagcacccaacaccccccagtttactctcagacgatttgtagtggaatagctccagtgagtcacctccgcatcaatagctttccctggaatcctagagggcaggtttccagcaagttccaccagcacagcaccacagcaagtattctacctgcctcgagccatggttgtgccctccctacaaggtctgaatttcatccctgggaagtagggagcctcttccttggatgcttgctcacaaccctagaagaacctgctgtgctttctatctgctattcctttattcttcagagtttctttttttgctagcaaatccctcattattccagtcccatggctcactgcaacctctgcctcctgggttcaagcgattctcctgctt[134 bp omitted]tgtcctcccaaagtgctgggattataggtgtgagccaccacgcctggctgcaaagaatctttatgttaaccattctctgttcacattagtctgtggtttctccctcggtaagaccctgagttatactacaagaaataggctcttcatgtatacatatttcaaaacatcatgttgtacatgataaatacatacaattcttatgtgtcaaattaatagatttttctataaaaagaaataggctcttttttcttaaattatttttttgaaatagagatggaatcttgttgtgttgcccaggctggtcttgaactcctggcctcaagtgatcctcccgcctcggccttccaaagttctgggtttacagacatgagctaccacactcagcctgaaacaggctcttaattccggagactttctaaaaacatagaggtaaaagcctcagttaccctatacactaaaatcctgtgattttctcagaattcttgtgggatggaggatgagaaaaaggaaagagccatacagactagaataattaaaagccattttgtgagacaggtgagaactgatcacaaggtggaaaatgtctcatctgaatagacagagcacagaataaacagattcagggaggactatcagatatggtcaacattaagaaaatattaaaaatggagttgagcagaggttacagaaaatatacagatacgagttgaactggaaatatgtggccatgttgtttatttctttgaaagaagagtttaattgtcatatactaggtaatggagaacaattgtaggtttgtttcataatgctcatgacaagagaaatagaatgttttaggtaaagatatctgtcattagcatttaatatgaactagtaaaaacaatggaatcagcaaataaaatcaggaatagaataattacaattcaggcagcagaaaatatggagctggccgggcgcggtgggtcacacctataatcccagcactttgggaggctgaggcaggcagatcacttgaggtcaggagatcgagaccagcctggccaacatggcaaaaccccatctctactaaatatacaagaattagcagagtatggtggtgcacatctgtaatcccagctactcaggaggctgaggcaggagaatcgcttgaacccaggaggcataggctgcagtaagccgaaatggcaccgttgcattccagcctgggtggcagagtgagactctgtctcaaaaaacaaaaaaagaaaagaaaaagactgaacaggagaaaaggtccctagggaaaccttgcttatggggaaaatgaggaagagaaggctgaaaaaggggcaaataataaatgggatgcagatcagtaagaaacagacaattgaggaggcacaattgaaaccagggcaatgttatgaacaaggtaattcataggagggaagctcaaagaggtatcaggtaaatcatgaaatgtccaaattaaaaattagataccctactgttgcatcacgaggttaaaaaaaaaacagagagctacccctttatacccactattgaccaaaaaatgagaaactctggtactactaattgttagcagaaacactggggaagccagaacacttgtacagtgcagctaatctgagaataatatggtggtactcagtcctattctggatgaggtactccatgattaggtgcaaatcctctcttctctacacatccctgagaaattctcataccctgtaaggaaacatttatgtagaagttgattgcagaattgtttgtattagatgggacttggacacaatgatcagcctccatgactaggtgagtggttaagtatgatgtggtgctggggacattgtgaaatactatgtagcaatttgaagaacaaagccagacaaacacactaaaatatggagagaccataggaatgagtgaaaaaaaaaggaacagaattgagaaacatagtacaatatgtttaatatataataaaaatacatactcataaaccaatacttcaggctttaagagaatatcacacaatttcaaggttcaaacacattagatcagctgcccatgggaggaggcataaagaatggatatggagaattggaataaaagaaaagacctggccaggcgcggtggctcatgcttgtaatcccagcactttgggaggctgaggcgggcagatcacctgaggttgggagttcgagaccagcctgaccaacatggagaaaccccatctctactaaaaatacaaaattagctgggtgtggtggcgcatgcctgtaatctcagctactagggaggctgaggcaggagaatcgcttgaacctgggaggcagaagttgcagtgaaacgagatcgtgccattgcactccagcctgggcaacaagagcgaaactctgtctcaaaaaataaataaataaataaaaataaaaattaaaattaaaattaaaaaaaaaaaaagacccataatcccagcaaagacctgtaatcccagcactctgggaggccgagtcaggcagatcagttgagcccaggagttcgagtccagcctggccaacatggtgaaatcacgtctctacaaaaaatacaaaaattagctgggcatggtggcatgtgcatgtagtccccactacttgggaggctgaggtgggaggatcgcttgaacctgggaggtggaggttgcattgagccaagatcatgtcactgcactccagcctgggccacagaaattttaaaacacttggatgtataagaaaagactaagatggggggcaggggtagagtaggaagaataaaaaggtcctagataagacagggtggtatgtgatacagagtacagagactagagacagctctcttgccaaaaggccaatcaaagaagacaataatgtggcaagggtcatacatggaaatggcatttaggtatttgagggctattgtcaactatctccaattgactccaaaagtttagaactttcaagatgggttatcttcagagtgtttcaaaggcatcgggctttcctagggaaagtgatactgacttccatgtccccatctgtctgggtcatgctcactcacctgaacagctctgatgtggggcttccccctccagcatccatggcccctctccttgctccaacttgaaggcagcctctgacttgggaatttggtaccctgttaacaggacatgatacacgattgggtccagctgattgggtttcaggggcctttcagtgacactttccctttgcttttcagaaaagtaaacacatttcactgggaacagagtaataatcacagaggtgaaaaggaactgaatcccagacaaatccaggatgacaccatcacataggttaggtgtcgggcagcactcagcagccaagaatggaaataccctcattagcagatgcatagggcggccgtgcttacccactgagagcaggtggctgtagttctctagtgtcacatcccagtacaggcgtctctgggcagggtccaagtgctgccactcctccttgctgaagtccacagtcacgtcctcaaatgacactgaagcctgtaacgacacaatgctgttcaaggcagcatggtcagcactgggggatggaagaaggtagatagcaagttgtttttaatgctttttaccataatgtatcatgtagggttttcactaagtacttagttttgtattttattttgtgagagctaaaaaacttattaaagtatcttgacatttgttgtgtactacattaattcatttattcattcattctcttttcaaaatgaggattttaaatgggctctctttaagtcctccagctaacttaaaaacaagatactggccgattatgtgtcagatgatgtgctaggcaatggtgataaagagttgagtaaaatataaagcaacttaaagacttggataaccaacagcagacacaaagggagctttaggaatttggaagaaaagtataggaggtataaggttagatttcatagagacagtggggcgagagttatctagaagggagaagcatgagcaacagtgtggagaaaggaaaatagaaaaatacatggtggattctgggaactgcaagtagtaccatataaaggaaaggagtctgtatagtatattgagaaggtgactatgaggaaaatccagtagagatatactagcatcagaaaaaggaacaagtctttttttctaatagagaatggactgcaatttatatgcaggaaaagacatgatggtaattgtgtgatttcaaacagtattcaacatacatcaggctgggcatggtggctcactcctgtaatctcagccctttgggaggctgaggcaggtggatcacctgaggtcaggagttcgagaccagcctgaccaatatggtaaagccccgtctctactaaaaatacaaaagttagctgggcgtggtggcgcacgcccgtaatcccagctacttgagaggctgagacaggagaattgcttgaacccaggaggtggaggttgcagtgagccgagattgtatcattgcacttcagcctgggtgatacagagtgagactccgtctaaaaaaaaaaaaaggattgatcacgaggaatgtttgaaatgggtgagtccagatcagtctggagatgcactacagagtttatgtgagagaataagacaatctggacttaaggcagtggttgtcatgggcaagtaaaagaaggtgttggctgggcgcagtggctcatgcctgtaatcccaccactttgggaggctgaggcaggcggatcacctgaggtcaggagttcgagaccagcctggccaacatggcaaaaaccccgtctctaccaaaaatacaaaaattagccgggcacggcgggtgtctgtaatcccagctactcgggaagctgaggcaggagaattgcttgaactcaggaggcggaggttgcagtgagctgagatcacgccactgcactccagcctgggcgacagaacgagactccatctcaaaaacaaacaaacaaacaaacaaaaagaaggtgttcatgctgtgttttaaagagcctgaattatgggagtgagaaaaagaattctagggcaattctcagttatcggttttgtacaaccatgcagacagtggtgttatatactgagaggggctagtagattaggaagggagtggggaagagaatgaaacataatgttacattttgtccatgttgaaataaaggtggtaaaacatgcagggagttatacaataagcttttgggctattatagaggtaagatttgggagttctcatatagagctgggaaacagatgagacgaaccaggaagggcacacagatagagacgatacagaaaccatctcttacagaccatctctaaaccaagtgtatttaagtcagaaatcagtaataagacgaaacttttctgaaatcatcattttaaagtttaaaaatacagttcaaaataactgatcgtctaagaagatacactcaatatcaatgtaatcagtacatgtaagaatttattggattaagaaatggtaactaaagtggaaattagggtctccagtgctcatattacaaaagaataaagtccaaaattccatgcattaagcattgaaataaagacattataaaaataacaatagagtaaagcccaagagaaaaaatctttaaaaagcagaaatcaatacattcaatgccatcccaattgaaatcacaacaggatttttgtaaaatctgacaaaccaattctaaaatttctgtggaagtgcaaatggccaggaatagctaaggcgtttaaaaaaaattattttgtatcttgttttcagagacatggtctcactttgtcacccaggctagggtgcagtggcgcaaccacagcccactgcagcctcaaccacaggcatacgtcaccatatgctgcttcgttttttttttgttttgttttttttttttgtattttgtagagacaggggtctccctatgttgcctaggctggtctagaactcctggcctcaagtgatccacctgcctcagcctcctaaagcactgggattgtaggcgtgagccactgtgcccggcctgccaagacactcttgaatagttaaagcaatgtgggaggacatgctttacaagacctcaagacttacaaagcaatggaaatttaagacattgttgtcctggtgctaggatagacaaataatccattgcaacagaatatagagtacaggccgggtgcagtggatcaggcctgtaatcccagcactttgggaggctgaggcaggtggatcacttgaggtcaggagtttgtgaccagcctggccaacatggagaaatctcgtctcttctagaaatacagaaattacatgggcatggtggcacgtgactgtagtctcagttacttgggaggctgaagcaggaggatcactagaacctggaaggcggaggttgcagtgagccaagaccgggccactgcactccagcttggacaacagagtgagactcagtctcaaaaaaagaaaaaagagtacagaaacagacccacatatacagtcacctgatttatgccaaaggtgtccaggcagatagtgaggaaaaatattttcaacaaatgttgccagggcctgggcgtggaggctcacacctgtaaccccagcactttgggaggctgaggcaggtggatcacttgagctcaggagtttgagaccagcctggacaacatggcaaaaccccatctctacaaaaaacacaaaaaattagccaggcatggttgcgtgtgcctgtagtcccagctactcaggaggctgaggtgggagaatcacctgaacctgggaagctgaggctgcagtgaaccatgactgtgccactgcactccagcctgggtgacggagcaagaccctatctaaaaaaaaaaaaaaaaaaaaaaaaagaaagaaagaaaagaagacaaggttgtgtatagaaaaaataaagtaaaatctgagctctatttcacattacatgccaaaacaataacattgtttgaacctgggaggcggaggttgcagtaagctgagatcacgccattgcactccagcctgggtgacaaaagcgagactccatctcaaaaaaaaaaaaatcaattccaaggccaggtgcagtggctcatgcctgtaatcccagcactttgggaggccaaggcaggaggattgcttgagtccaggtttaaaaccagcctgggcaatatggcgagactcggtctctacaaaaaaataaaatatatagcacacatataaaaattagctgagtggggtggcaagcacctgcagtctcagatactcaggaggctaggctggaagatctcttgagcctggaaggtggaggctgcagtgaaccatgtttgtgtcactgtactccagtctgggtgacagagtgagatcccatttcaaaagtatatataaattccagatgtattatagacttaaatgtgaaaggcaaaaactataaagcctttagaagataatacagatggctatcttcatgaccttgaattaggaaaatagttctcaaacatgaaccatgaaaattgataagtctttctacaacaaagcttagaactactattcatttaaaacacagcattaaaagagaacaaagggaaagtcacagagtagaagatatctccaacatacattatcaacaaagggctcagctagaagatgtagagaacttgtacaaaccaataagaaaaaaagagaccacctagtagaaaaatgggtgaagcattcattttacaaaagaggaaatccaaggctttaataaacataaaaaaaggtttaaccttcttagtagccagggaatacaaattaaaaccacaaaggatagcattacacaacccctagaaagtcttaaatgaaaaagactgataataccaagtgttgaagagaatatggtgcaagaactctcatactgctgatggaggaggtgggaattgctacaactgtgctggaaagtattttggccctaactggtaatgttgaagacatgcaggcaatatgacacagtgagtccactcatggaaatatatatgcccacgtggaatatgtgcacatgtacaacaggagatgcattcaagaatatttatagtggcgttattcaaaatatgtataatatttcatgataaaaaggtttaaaaacagtgattttaaaaaatcagtattcaatatatgtacagtatcaactgtcttcgtaaaaaaaattaaggatattttcttttcttttctttttttttttttttgagacaggatcttaactctgtcgcccaggctggagtgcagtagcttgatcttggctcactgcaacctctacctcccgggttcaagtgatcctcctgcctcagcctccctagtagctgggattacaggcacccaccatcacgcctaaccaatttttgtatttttagtagagacagggtttcac[131 bp omitted]tgagacagaatctcactctgtcgcccaggctggagtgcagtggtgcaatcttggctcactgcaacctctgcctcccgggttcaagcaattctagtgcctcagcctcctgagtagctgggattatagatgcctgccacagtgcctggctaattttgtatttttagtagagatggggtttcaccatgttggtcaggctcatctagaattcctggcctcaagtgatctgcccagtcggcctcccaaagttctgggattacaggtgtgagccactgtgcctggcctctttttttacttttttgagataggatcttgctctgttgcccaggctggaatgcagtggtgcaatcacggctcactgcagcctcaaactcctgggctcaagggatccttcccgcctcagcctccttagtagctgagactacaggtgcacaccaccatgcccagctaatttttaaattttatttttacttttttgtagagatggtggtgcaggagggtgtctcacagtgttgctcaggctggcctcaaactcctgggctcaagcaaccctttcacctcttaagtagttgggattacaggcatgagccacagcacccagctgtaaaaacttttgcccaggctggagggcagtggtgcaatcatggctcactgcagcctcaaactcccgggctcaagggatccttccggcctcagcctcctgaatagctgagactacaggtgcaccccaccatgcccagctaatttttaaatttttaaattgtatttttacttttactcctccctgtccatctgagtgtttcctgttccccgggactgttctctgtggccctgcaactgctcttccctccctctggctttccccgcttcccttgctgcttcctgtacagctgtttgctgcctgcccagatctgtccctgctccctttgctggtcgttgttccctctgacttttccttggtccctctgtttcctattccctctaaatgtctcttgttccttccgagtacccccgttcttttatcgctttctttgactctacctggatcgctctaactattcatgcctcctgtttcctgttctgactgtcctgtgttccctttgttgtccctccagctgatccttgttctgtggcaccattctgattgtgtgctagtctacctgactgttccctggtccctaagggcctttcttgttccttccagctgttcctggctcacacagactgactgctgttggattctgctgactaatctctagtctcctgattcttccctgtccttggacagttccttgagtacatttctttctttccattctttccttctttttcttcctcccttcctgtttctgagacagggcgtcactctgccacccaggctggagtgcagtggcacaatcacggctcactgcagcctccacctcccaggctcagatgatcctcccacctcagtaccaccctacccggctgattttttttttgtatgtatatatatatatatatcacacacatatatatatatacacacacacacacacacacatatgtgtacacacacacacacacacatacacacacatatatttatttattttgtagacatggggtttcaccatgttgcccaggctggtcttcaaacaatcctcccgctttggcctcccaaagtgttgggattacaggtgcgaaccaccgtgcctggccattgaatacatttctactatgctctcccgtgatgttcatgcatctggtctgtggaccacactttgagtagtacctaactagctagcttatgcccttacccactaaagtgcactattgcgtgttctatgccacagctggattctgtacttccactgcctccattactcaacattacatctaactattggctggttcctctgattgcttcctgggtagggtgaccaagtgtctcagtttgcccaggaatgttcctgttctagcactggaagtcccatgtcccctcagtcacaggcaaaccaggatggtcctgggaactctggctgtttcccagactctccaactgtgccttcaccccagtaactactgcatgggccctcgggctgttaactcgcttcagttataccattctttctggctctcctctagtctctctagctggccactggtcaatcaggctgctacccacactggatacatgtttaatgctcacttgacttgttccctagttcctctggttacttcccagggcctctggtggaccctcagccccaagcacattttggctgctccctctggctgccccccagcctcagtgactgttccttgctccaggtgttccacagtactctaggccattctgcagcttcagaggctcttctctcatctttccacctgttccatgggctctgtcccttccctgatccctctgcccattctacagcctcagcaattgtctcctgcttcctctgactgcaatccattctctgggtcgtatttcacatttcttgttccctggtatcactgtcttttgcctgtgccctcaagctctcttctaaaccaaggaactgcttcctggttcctcgggaagttgcttgtccctcaggctcatacccagttccttggatatgtttgccttttccattttatctgattcttctgcttcctcacccctctggatactgactgctccgtctggctgctatttggttcctctatttcctgatacctcctcctatttcatgatccttctcactgttctttaaccctcggctcttccctgctcctcagtgatcaccacttctccagcctcagaaactgtttcttggtctctggctccagcgtctgactcatgtcctgtttgcttcattattcttccacctataccctggaccccttggctattcttcatctctagtaagtgcaccatggtacctgttccttattccgttgtgactcctcccagccctctttaccttactgatccctctgcttcttctccatcttcagccactgtttcttggtacaactggctgctcctcaaaccctggggatatttttattggttcctaggtatctctgcctataccccgctccctgatgtttaatgaaaaaaccaagaacctaaccaataaataagtcaataaataatattccccccagggtctcggtcatttccatctcttgaggtgggtcagagatctgtggttgggaaagaagagatgaatggagaaatgtgccttgcagagcccagaatcattcgtctagaaatccctactattggctgggcaagaggccatgtgcaggagtggggaggaccacattgtcatggccctaacctgtgggtccgtgactgacatgattgagcagagcttagacaaggttgaagtgtactactgtcaagcattgattcccttgctatttaatgaccctatacctttgactcaaaaacataatttcaatgacttgacagaaagatttatttatttactatttattttgagatggagtctcactctgtcacccaggctggagtgcagtggtgtgatctcggctcactgtagcctcaacctcctgggctcaaatgattctccaacctcagcctcccaggtagctgcgactacaggtgcacaccaccacacctggctaatttttgtatttttgttgagatagggtcttactatgttgcccaggctggtctcaaactcctgagctcaagtgatctgcccgccttggcctcccaaagtgctgggattataggcatgagccaccatgcccagctggcagaaagatttaaatgtaggaattttatcatagcagttttaatcacaatagaaaacttgaaataccctaaatgcacattattagtggactggttgtggggggatggggagacattggtcaaagtatacaaagttttgttagagggaataagtttttgagatctattgcagtttggtggctatagttaataatgatgtaatgttatttcaaaattgcaaagggagcagattttaaatgttcacatcaccaaagaaataagtctttgaggtaatggatatgttaattaggttgatttaaatattctacaatgtatacaaatatcaaaacatcacattgtacaccataaatatacataattattattcgtcaattaaaaataaaatatgcagggtatggtggtgactcaagcctgtaattccagcactcggggaggccaaggcaggaagatcacttgaccccaggagtttgagcccagctgggtgtggtcccatgtgcctgtagtcccagctacttgggaggctcaggtgggaggatcgcctgagcccaggaggttgaggctgcagtaagctgagattgcaccactgcactctagcctgggcaacagagggagactgcctcagagaaaaaacattaaaataaataaataaaattaaaaaaatagtgaactggctaaattatggacatcataagtgtatgaagaaaaatacttgctgcttagcaaattatgttaaactgcccagttaaaaatgaggtaaccaaagagtatgattctgttttaaaactttagctatatatgtgtatgtgtatagtatgtagcacactctggccccacacgtatactcacacacatgcacacatgcacatacaaaggaaaaaacaactgaaaggaaatacagctaaatgttaacactggttaactttgggtaatgttggaacgacaagtaattttttagtttcttctatttgctaacgtatactttctaatattttattatgaagttataaaatgaccaaaaaaaaaaatttaaaagtttaatattatcctaatgactgcatgaccctgagtccctgagataatgaacccttccagagccaacagcatccacaggtaggtctgaaaggagggagctgtcgggcagggtctggctcgctcgtggtcctcctcggcttatagaatctcaatgggaactctgatctgaaagggagctctgagcgggaaacctgatctcagctgtggtgcggtgagggtggaagacacagtcaggagacctggctccagtctagtgttgtcaccgccaacttgagaggcctgggcgagtcatgtgtcttctggggcattttattcatcttttttttttttgagtctcactcaggctggaatgcagtggcatgatctcagctcactgcaacctccacctcctaggttcaagccattctcctcctgcctcagcctcccaagtagctgggattacaggcatgtgccaccacattcagctaactttttgtatttttagtagagatgggggttcgccacgttggtcaggctggtcttgaactcctgacctcaagcaatccacccacctcggcctcccaaaggtgctgggattacaggcatgagccaccgtgcccggccattttattcgtctttgaaagaagggacagccagaacggccccagagactgtggtggccctactaccctgccagtctctaagttccaaagaaaaaggatttttctctacctaaatcaggatagaggagaaatcgccagatccccagagacctgggggaaaggggcactggtggggatcagccgacatctgtaaagagccgatggagagggaagggttggtgctgtggtgggggatggaggctccctggctatggatagtggctgcttctacctggacctcaccctcatttgccctgcagggagctgcccccactccctaggctgtagggctcaccttccacattctccctctcctctagtgtaatcagccacattacactgtccactgaaacacacggggctttggatgtggcctcatcagccaagtggtgctcactctcagcaagaggaccctgatctgtctccagggtggcaggtccggaatctgccacttcctctgactcacctgcttctgcccttaggccctggggacaggtcagggtatctcttcactgaatgaattcttgcctctggggtcctctccctcctcacctcacatgagctgccacgtccctctgcagccagggccggggaccatgggggagagtccccattagctgccatgttcacgctgggcctcagccctcaggctctcctgctgacaaccccactcttccccaagctggaagctgagctggcatctgtggactcaaccggagctgctggggcgaggcaagcaggggtcagaaggaagatcctgcagtttccactaagaagcctggcccccagactctgcagaggctccaagaaaccctggaaagacagtgtccacatggtcatcactccacgttcactcacaaatgttttctggtggtgcccaggggccgctcactgtgctggatgctgcggaagagaaaagttcggtaaaacccacaccaagtattaaagcaaaacatggggaaaattcacaagatctggtgtaaaatgaatgagggtttgtatttaagctcttctatgttctagctagaatttggggaagtcactttatgtgaagtttcttcatctttaacaggatgaaaatacctatctcatagggttgttagaattaaatgaaatgatgcttctacgcacacctacttggtacctggaacatgctcaactcatattaaatagtgctattattacaaggtgcgaggcatgttttattaggtacctcatttaattttcacactcatcctgtggactaggcattactattattactaatcccatttaccatcagatagagctgttcagaaatattaagaaatttgccccaggatcactcagataagggggaaggacaaggattcaaacccaggtatgcctggctccaaagcatactttcttaactattgagccatttggtactctatacatggcagaatcacaataaacactgtggttcctgctaccttcaaagtgctctggctgaggggtgaccatgccacttgagcataaactgagcttctgtgtaattcagtgtacattctatgcaaaggatagagcccatcttcttctgtcaaagatgaaaactcatacttatcccttcccatcaggccctgaaaacctgcaggtctgcacaggctcccaaatccctatagcccacaccgttgacaaaaaactgtgtcccaaatggtgtcatcaactggtttccacaggctcctcaaattatcaccaacccaggcagcacaccatcaataggatcaatgactcccataaaaccctcagtaatagaagttctagtccattacaaagcaactcacacagtactatgataaccaatgtccataggtcccaatccaggactgctacaggccccccaaaactgacttgtaatccctgtgaatcccagacttgcaatcattcaccaccttagcaccccaatcaataaactctcatggactgaatcgatgacctcagatactgacatttccaacacttccaggcagaaccaacacgtcatttacaaggaaaagggatcacaatggcactagatttatttgcaacaacagaagccatgttagaagaaaactctacaaatcattgagacagaaggactgacatccaagaattctaaacctgccctag[367 bp omitted]tagatataaaagcatttctagcattttatgccaatattccaatctcaggagaacactcaagggaatagtctaaacaatggtaaatggaatagaaacagaaatgtcaaaacaggaaagcagttttgagaaaggattcttgcaattgatatataattatatctggataaagaaaaacaatgtaattgggcatttgtagtaaataaggctgttactattaactatgtggaaatttaaaaattccctggccgggtgccatgactcacgcctgtaattccagcactttgggaggccaaggcgagcggatcacgaagtcaggagatcaagaccatcctggctaacactgtgaaacactaaaaatataaaaaattagccaggcgtggtggcacgcacctgtagtcccagctacttgggaggctgaggcaggagaatcgcttgaacctgggaggcggaggttgcagtgagccgagatcgtgccactgcactccagcctgagtgagagagagagagagactgtctcaaaaaaacacaaacaaacgaacaaacaaattccctggaaaatttactgagtgaaatgaggagaaggcaaattacaaatttccatgggcagatattggtaccatattatttggatttagtaatatagaaaatatatacaatcatatttgtaaggaaggtaaaggcaactactagcagaaattgattaaaaaataatcaaaattccaaacaatcaaaattcaaaagtaataaaaacctaaaaggaaagagaaacatgactgaggccgggcgcagtggctcacacctgtaatcctagcactttgggaggccgaggcaggcgaatcacgaggtcaggagttcaagcccatcctggccaacatggtgaaaccccgtctctactaaaattacaaaaattagctgcgtgtggtggtgtgtgcctgtaatcccagctactcaggaggttgaggcaggggaattgcttgaacccaggaggcggaggttgcagtgagctgagattgtgccactgcactccagcctgggtgacagagcgagactccgtctcaaaaaaaaaaaaaaaaaaaagagaaacacgaccggccaggcacagtggctcacacttgtaatcccagcactttgggaggctgaggcaggcagattacctgaggtcaggagtttgacaccagcctggtcaacatggtgaaaccctatctctactaaaaatacaaaaattagccgggcgtggtggcaggtgcctgtaatcccagctactcgggaggctaaggcgtgagaatcgcttgaacccaggaggcggaggttgcagtgagccgagatcgtgccactgcactccagcctggggggacagagtgagactctatttcaaaaaaaaaaaaaatagtaaacaaaaaataataggagaaaaaaaggaaaaaaaataataggaggcataaaatcaagtatgttataatgcaaagaaattgaaatgagttgaattctgctacaaaagacaaagattatgggactgggctaaaaaacaaaatatagttgcaacatgtctaaaacaaaatgatgaagatgtgaaatgaagcatttgatagaaacacaccatatcgttgatcattctttccttaatggttggcttgttaggaaaccttcacctacctcagggtcatgtaaaagttttatcattttagctttcacatttaggtccacagtccatctgggaaggattttagcatgtggtatgtgttagagtcaagattcatttctttcatatggaagcaagatgatccagcaccatttattgaaaagcctacgcatggccgggcacagtggctcatgtctgtaatcccaacactttgggagactgaggtgggtggatcacctgagctcaggagttcgaggtcagcctggctaatatggtaaaaccctatctctactgaaaatacaaaaattagccaggcgtggtggcagacgcctgtaattgtagctactcgggaggctgaggcaggagaattgcttgaacctgggaggcgggggttacagtgagctgagatctcaccactgcactccagcctggggggatagagtgagactctgtctccaaaaaagaaaaaaaaaaagaaaagactatcctttctccactgctctgtagtgtctccttgtgatcatatatgtgggggccattcctgaactctgtatttccattggtttatttgtctattctgggaccagtgttatagtcttaattaatgtgctttatattaagtcctgataaaggatacctaaattggactacattaaaattaaggacttctgttcatcagaagataaaattaaaaatgtaaaggcaaatcctacagtggcagaaggtaattgtaatacctatatttgacaaatgattaatatctcaaatatatcaagaatgtctagaaatcactaagagccacagaaaaagggcaaaaggaacaggcatttcacaaagaaaatatccaaacagcaaataagtttataaaaagatgctcgacttcaccagttggcaaggaaatagaagttaaactacaataagataatcctccacataatcctccatatctacaataagataatcccaccagaaattgccaaaatgaaaaagatgggaaataaacaagagtgggcaaggatgtggagcagccaaaactcatagattgcttgttaggatcataaactagtacatacactttgaaaaactgtttggtagtatctattaatggtgaatacatgcaacatcctatgaccctgctatttgactccagttctctctcactcaagagaaatgcaaatatatgtttactaaaagagatgataatgctcatggtagctttattcaaaactaaaaattatgtaaatgcccatcaacatcagaatggatagacaagttgtgttatatttatacaaggaaatactacacagcaatgagaaagaataaattgccatactcaacaagcatgagtctcatcccatgaacactctgttaaactaaagaagccagactc[137 bp omitted]ctccacctccagggttcaagcgattctcctgcctcaacctcccaagtaggtgggactacaggcgtgcgccaccatgcccagctaatgtttgcatttttagcagagatggggtttcgccatgttgggcaggatggtctcagtctcctgaccccatgatctgagtgcctcagcctcccaaagaaagacacatggcttctttaaaactttttttgttttttttgagatggcatcttgccctgtcacccaggctggagtgcagtggcatgatcttggctcactgcaacatctgcctcctgagttcaagcaattctcctgcctcagcctcctgagtagctgggattacaggcgtctgccaccacgcctggctaatttttacatttttagtagagacggggtttcaccatattggtcaggctggtctcgaactcctgacctcgtgatccgtctgcctcggccccccaaagtgctgggattacaagcataagccactgcgcctggcctacaaaaaaaatttttttttagagacagggtcctgctctgtcacccagccaggagtgcagtggcatgatcacagctcactgcagcctcaaactcctaagctcaagtaatcgtcctgcctcagcctcctaagtcgctgggactacaggtgcatgccaccacacccagctaaaaaacatgacttcttgagagctagtaacatttcttcatctaggtggtggctatgcaggtttgtctggtctgttaaaaaatcatcaagctaaatatgcacaatgtgtgtacttttctgtattatatttcaatgaggatttaaaactatacaatttactaggcaaataccaagaaaatgaaagaagatctgaaaatacaattatcgtgggggaaattaaggtccaaagcactcaacagattaacaaaaaaggggaatatcttttaataataaaagaaacaataaagaagtactaactggcataaaccttcaggatcattcaacgcatacaaataaaaccagcacaaatgcattaaaccacatgaagtcttaaaaatcataattgtttttgtattatatttaacaagtgttgctattaaggttatgccagttttcaaaaggaactcaggaaatttatttttatgtgttaaaatggcatagatattatcttctttaaagttcagctataaacacatttagaactggtaccttttaaaaatggtacattttaactattttcctttctttgaattttggtctttaccaaatgttggagaggatgcagataaactagatctctaacatattgccagcaggaatgtaaagtggtacagccactctggaaaatagtttggcagcttctttaaaaactaaaatacttatcacttgatccagcaattgcaattctgggcattcataccagagaaaggaaatcttatgtgtatacaaaaacctgtacaagactgttcgttacagcttgatatgtaatagcctcagactggaaacaagcaaaatggccctcaataggtgaatggctaaacaaactgtagtaaatctataatatggaatactactcagcaacaaaaagaaatgaattatcgttctagcaacagtttggatggttttcaaggacatt[140 bp omitted]atggtgaaaccccatctctactaaaaatacaaaaattagctgggcatggtggcaggcacctgtaatcccagctactcaggacgctgaggcgggacaaccacttgaacccaggaggaggttgcagtgagccaagattgtgccaccgcactctagcctgggtgacagagtgaaactccatctcaaaaaaaaaaaatcacagactgtatggttccatttatataacattctcaaaatggcaaaactagagaaatgagaaacagatggttggttgccaggggttagggatggcagtgggagtaaagactataaaaggtctgggtacagtggtttgtgcctgtaatcccagcactttgggaggccaaggtgggtggatcgcttgaggccaggagtttgagaccagcctgggcaacatggtgagacccccatctctacaaaaaatttagaaagtagccaggcatggtggcatgcgcctgtagtctcagctactcaggaggccaaggcgggaggatcacttgaacccaagagttggaggctgcagtgagtgatgatggccctactgtacttcagcctgagcaacacagtgaga[157 bp omitted]aaaatttagccgggtgtggtggtgtgcgcctgtaatcccagctactcgggaggttgaaaaaaaaaaaagaaattaaaagaagacaacaaaatattcatgagaaccctgatcaaggtaaaagagaaaggaaaaaaaatatatatatatgtatatatacacccacacacctcacaagcatgcacagttttaggagtgaaaaaagaagctattgccacaggtatggaaatgatcaaggtaaattaatgaagcattatgcacagatgcacaaaaacataacatctctagcaaacatacactaccaaaattaatcccccccaccagaaatctgtagagcaataatcagagaaaataaaatagttaaaatttgccattttaaaaaaggcatcagttctaaatgtgtatatagtcgaacttaagagaatgtctatgctattttaacacataaaaaatggaaatctcctgatttccttttaataactggcataaccttaataccaacacttgttaaatatactaaaaacaagaaaactataagcaaattttttatagtggcaaaaattctaaataaaatattactaactcaggcctcctggtgcttaccacaggctgtgttcttacactgactgtatagaaaaagaagtgggcctgccttctctgttcttgtactgactgtatagaaagagaagagctcctaccctatatacacctctgcccaggctctagtcctggtctgaattgtgaatggagggacatggagttgaggaaaaagaaaaaaatacattactaactcaaatctgaccatgactcataaggaaaattgcctttgaccaacagaattatcccaggaaggcaaggatggatccacattatatatcaatatcattcattacaacaaccaatttaggaaaataacaccattaggctattacatcaaaaaggcatctgacataattcaagagccattcctaagaaaaatacaaatcaagataggaacatatgaaaactataaggacaccatcaggaaagtgaaaaggcacagaggctgggctgggcacagtggctcacatctgtaatcccagtactttgggaggtcgaggcaggcggatcacttgaggccaggagctcgagaccagcctggctgaagtggcgaaaccctgtctctactaaaaatacaaaaatgagctgggtgtggtgatgcgcacctgtaatcccagctacttgggaggctgaggcacgagaattgcttgaacccgggaggcagagattgcagtgagccgagatggcaccactacgctccagcctaggcaacagagcgagactctgtctcagaaaaacaaacaaacaacaacaacaacaaacacccacagaaagagaggaaatacatgcaaatcgcatatgtgacaagggacttctatcgagattatctagagaactcttacaacttgataatacaaagacaattcaatttaaaaataggccaaggatttgaatagatatttcttcaaagaagatatacagatgggcaataagtacaggaaaagatggtcaacatcagtggccactagagaaatggaaatcaaaaccacaagataccacttcacacctactaggaaggatagaattaaaaagacaataagcattagcaaggatgtgataaactggaaccctcatacattgctgctgggacataaagtggtgcagccgttttggaaaatggtttggcaattcttcaaaatgttaaaaatagaaggctgggcgcagtggcttatgcctgtaatcccagcactttgggaggctgaggcgggtggatcgcttgaggtcaggagatcgagaccagcctggcaacatggtgaaaccccatctctactaaaagtacaaaaattagctgggcatggtggtgggtgcctgtaatcctagctacttgggagactgaggcagaagaatcctcagcctcctgagtagctgggactacaggcacgcgcaccacacccagctaatttttgtatttttagtagagatggggtttcaccatgttggccaggctggtctcgatctcctgacctcatgatccgcacgcctcggcctcccaaagtgttgggattacaggcgtgagccacagcacccggcctttttttggagactgagtctcgctctgtcacccaggctggagtgcagtggcacgatctctgctcactgcaacctctgccttccgggctcaagcgattctcctgcctcagcctcccaagtagctgggattactggcgcccgccgccacgcccagctagtttttgtatttttaatagagatggtgtttca[143 bp omitted]caagagaattgtgtacagatcttatgaaaaataactttttttcttggagaaataagccaaaaaaattttttaaaactcttatgttttaagcctccccacataactgagttgctttttcacaacttaagtattctttgtccaatccagtatataagtgattgactctaactactactttgggtcttcatttctttatgaaggctcctgtgccacataaaacttgtattaaataaatctgtacacttttctctgttgatctgtcatatgtcaatttaactttcaggcccagacaaaaagaaatcctaaaagggaagaggtaaatttctacctcactccttataccagtcattccactcctgggtatccacccaagagaaatgaaaacatatgtccatacaaaaacttgtacgcaaatgctcatagcagcattattcataatagctaaaaagtggaaacaacccaaatgtccatcgactgatgaatggataaacaaaatgtggtgtatccatacaatgaaatatcattcaggaataaaaagacatgaagtacttctaaaataaactgatagaaacagatagtagaatggtggttgccaggggctgagaggagggggtaataagaagttgctattcaacgggttaaaatttcaggtatacaagagggaagttctagagattggctgtatattgcacctatagttaacagtactgtattgtgcacttaaaaatttaagagaatacgccacatgcggtggctcacaccagtaatcccagcactttgggaggccgaggcaggtagattacttgaggtcaggaattcgagaccagcctgaccaatatgttgaaatcctgtctctactaaaaatacaaaaaattagccaggtgtggtggcacgcacctatagtcccagctacgtgggaggctgaggcaggagaattgcttgaacctgggaggtggaggttgcagtgagccgagatcatgccactgcactccagcctgggtgacagagcgagactctgtcacaacaaaacaaaacaaacaaaccaaatttaagagggtggctttcatgttaagtgttcgtaccacaacaaacaaaataataaaaggaataaggtcctaatacatactataacacggatgagctttgaaaacattaggctaagttaaagaaaacaatcatggccggacacagtggatcatgcctgtagtcccagtactttgggaggctgaggtgggcggatcacctgaggtcaggagttcaagaccagcctggccaatgtctctactaaaaatacaaaagctagccgggcgtggtggcaggcgcctgtaatcgcagctacttgggaggctgaggcagggagaattgcttgaacccaggaggcggcagctgcagtgaactgagatccggccactgcactccagcctgggcgacagagtgagactctgtctaaaataaataaataaggcaatcataaaagaccacgttttatgattccatttatataaaatgtctagaatagaccaatctatagagacaggaagtaaattagtggttgcctgtggctaggggtgagggttgggaatgaggaatgattgctaatgggtacgatgtttccttttgggatgataaaatactctaaaattagattgtgatgatggttgcacaattcagtgaatatgctaagaactgctgaactgtaagctttaaatgggtgaattttatggtagatgaatgatacaataaagctgttagaaaaaaaaaatcatagctagtaagtgccaagcagggttgcaaagccaatgtctggcaaggggtaggtattcaataaatgtttattgaatagattaatgaataaacacctttcacattcaaataaaaaatgcccaagttattttcattaacattagcaacaagatagcaaataccctctattaaatgtcactcaacattgttctgaaagctctaactagtgcaacagaagatgaggtgatcagaataaatatttgaaaggaagagacagtatcatttttaattggatggaatacgatagctaggaaaagtaagagactgtaaaaagcaactacattcatatgataatttggtaattggattgaatatgaaataaaattataaaaatagattttccctatggaaatagaaaaaaaatatgctattcacaatgatgataaaaacaaaggtaaaatatctaaggatgaactgttaaaaaaaaaaaaaggtgttggacccataagaaaactataaaaattatagttttagtggttatttttgaaactagataa[133 bp omitted]aacctcgtctctactaaaaatacaaaaattagctgggcagggtggcacgcgcctatagtcccagctacttgggaggctgaggcaggagaattgtttgaacccgggaggtggaggtcgcagtgagccaagattgcgccactgcactccaggctaggtgacagcagagcaagactccatctcaaaaaaaaaagaagaagaataaacgcacaagaaaattaattaaagcaaccaaaaagaaagcaagggggactagttctacatgatgttaaaactatttctaaagtcaatatgattttttaaaaaggagtagatacatatatcagaagaactaaacagagttcagaaataaaacaatacacatttgggaacttatgtgacaaaagtgacatttaattgaattagaaaagggtattcatttaacgactggtgctggaaaattagctatccaaatggaatatacgaactgattccatctcataccatacaccaaaataaattccagttagattaaaatttaactttaaaaaattgaaataaatatattaaaaataaatttaaggcgtatttgtttgaacatgaaatgaggaagtcactaggcaagacaagacactcagaacctgtaaaggaaaaaggcagatatatcttaatagatgattttttaaaaatcaaatgtgaagacacctttcaaagtcaaaatatagagatagaggaaatatagttacaatataggttaatattcacaaattagtaagaaagacaaaccacctaaaggaaaaaaagggcaaaggatatgaaaaagtttaaatatatatttcaatggccaataagaatgaaataatgttcagtcactagttgtcaggaaaacgcacatcaaggcaaactagatacccttgtgtttggccctcagaatggggtaaattaaaaaaaaatccaatgtggaacaggattttggaagaagccttctcatatgttgctggtgggagttccaattttacaaaagttttggaaagtagtttggtggtatgtattgaacttaaaagcatcattcctgcacgtaatgatcactcaggtgacagcctctaaccacaatttagaaatcaataacaaaaatgtcaacgttttgggaaatcaaaatctcatatctaaataacccagtggtaagagtgaacattgcaactgcaattagaaaacattagaaggaaactatagtggagatgctacatatcaaaacttgtgggtcagatgctcacgcctgtagttccagcactttgggaggatgaggtgggaggactacttgaggattgcttgaggccaaggagttcaagaccagcctgggcaacatagcaagaccccaatctctacaaaaaatttaaaaattagctgggcaagcctgcctgtagtcctagcaacttgggaggctgaggtgggagggtcacttgagcctaggaggttgaggctgcaatgagccatgatggtttcactgcactccagcctaggcaacagagagagattcttgtatctttaaaacaaaaatcagcctgggcaacatagtgagaccccgtgtctacacaaaataaaaaattagtgggtgtggcagcacatgcctatagttccagctacttgggaggctaagttgggaggatcgactgagcacaggaggttgaggctgcagtgagccatgatcgtgccactgcactccatctctgggcgacagagtgagaccctgtctcaaaacaaaataaaaccgaacagcagcaaccacaacaaaacatgtgacacggagctaaagtgttcttagagaaaaatttataaactgaatgtttatattataaaataaaatgactggatagtaagataagcattaaattcaggactttaaaaatgagaacaaaattaaaaaacagaaaagaaataacgaagttaagggcagatattaatgacagagaaacaaagatacaggaggaccaacaaagtcaaaagtaggttttgaaataacctcatctcagacctaaagaccacctatcactgaccccaggaagctgcatatctgattccacagccccccatcactagtcccaaagaaacgcatcactcacccagcaggaaccttggtcaatcacccaataaaccccatcccacacctcacagacctccagtagtcaccccgcacagccctttcttacccccacggacttctcatcactcatctcacatataccttatcactcaccctagagaccctgtatcactcaccccacagacccccttattattcactccggtgtccccaacactcatcccacaggctacccatcaactttctctagtgacccatcactcacccacaaaccccaatcactcattctgcacctccctataaatgaccccagagaagcctccttactcatcctactgagcatcttcgagtacaaaatccatgtcataacatccccataattatcttaatgcttgatccatgtcataacatctccatatttatctcaatgcttaagtggccctaagtccgtctgttaaactcactcccagagccttaagtcctgaaaactgcttcgaggaaccccggcgcttctggacttgatctgcacatgcttagtgtcagctccgaagcggccgctcgcccacaattacacctggtgggtgcccttacaccgcgccggtgcgtgcgtgcgcgtgcgcgtgtgcgtcgaaggagaggcgggctttccaatttccttcagtgactctcaggcaaggaacatggctgtctccttgggagtgtctctacgggagccgccatcttggaagggcggtcatttctgccgcggagcccgcggtcccctactcgatatacccctgtgggattttccagtggccgaggcactgggccatggaatgtaccaccaggcttctcccctccgccgcagcctctaggagttagtcacctccgaggccccggcgggcgaggcgctttgcctcttccgccctcagggtgccctcggcctcaggccgtccctaccggggagcctccgcctctttaaatatcgcccagcccccacccccaggagcaggtcgcgagacgcacccgcccccgcccctgccgccgcactgctctgtgggacgcggcgacccctctcccgcggcggccgggaccccgcgcccaccgcgtctggagcccacctggcggccccactggctacatttccgacctggaccccggccggctgcgggaaacactcggcgtctcggctgtcaccgaacctgtgcagttgccgcggggggagtcgtgcgtgtcagatttaggccaggaagcggaagtcgccagcagcgagagtttaacctctgtgggcgcagagggttgcggggattcagcgcccgggaccgtggatctgtgcagggagtcataggtgtgtgtgacatcagtggtggaacattttggctcgttttcacaattcagtcattatcctttctgctttcctcctggaagcattaaggttgaagttttcttctaaagatcaaagttttgatttgttatattagttcggatttgtttgatttttgtttgtgttcggtttcaagtgctgatttgtaacttttctcccccccccacacacgccttttgacccctgaattatttaaaagtccattgttggagtggcaaacatcctccgagactcaaagggcaaggccatgggcgctttattccggctgctgctccaggaacgtgggaaagcagcggagttttattctaggggaaggaaacaaaggcggccgagtgccagctgcacgtttggtgggatttggtcatcaggggtggacatgctgcccaatggagctgtcggcagtttgacccagcttggtccgtcgcgtcctgttctaggaatcgattattcaaagaaggaatttagagggactgcagaaaatgttacaggtcttaacaccattttgcatttccgcaaacgaacaagaagttaatccctgtgttagtgatttctaagcccatttgccttgtggcccaagaacgttgagtttgaaatttgatgaaacttgccttaaggctcaagtacgaggccagctttcaaaaatggttttgtgccttgattgaaaacactgtatcttctagttgttggatttatcgtactctgcggctctattggttcaagcttgtgcgttgggccttttaaaatgtgtgtttcctgataattcccttcagcttgtcaactgggggtgatgtggcagggagaaagagagagaggagagagagagactgtactggcaggttttccttgtgctattcaatttttgcttcctatgttttgaagttttattattaactgcaggtttcattactgaatagatatagccaaattccttcccccaaaagattataaagtttcctagtcctaccagcaaaatcattaagttcattaaggcaaatcccctccagcgctggatgttgatgctgtctttaattttgtatttttctgactactttgtgcaattgaggattgttttggtctattggccatttggcttttctcttttgcaaatgttcatatcctttgtccagttttctttagggtgatttttccttttcgtatcaatttgtaaacagtgtacaaattacattgtacattagggatattaacagtctgtcagttacactgtacattagggatattacattagagatattaacatctttgtccattaaggatattaaccatctgtcagttacattgcagtatttttccctaaactctttttgtcttttgcattttatgtttttttaaatgtgcaattagaaaaattttatatgggctgggcacagtaatcccagcacccatctctactaaaaataaaaaaaaaaatagccaggcgtggtatctcaactaaaaaaaaaaaaaaaaattgccgggcatggtgttgggcgcttgtaatcccagctactcgggaggttgaggcaggagaatcgcttgaacttgggaagtggagattgcagtgagctgagctcgggccactgcactccagcctgggtgatagagcaagacttcatctcaaaaaaaaaaaagaaagaaaaattgtatgtgtaatatgtaactagtgaaatgtagcctctgatcagatatgtctaaactttcttttatggcttttgtatatcccatcttgcctagtttcacttccctattccagatagaaagataatcttaacatgtatttcagtgtttttattgctttaattttttctactttaatctagttggaatttactctggtatatggtatgaaatcaagatcaagcttgaacaagaagcctgtgtcacacttttttctgtgtcaaataaaaagagactttaattagaaagacagactattgcaaaagggagaatgctcccatctcagaaacctgagagcatcttgaaaccaaacagaaaaaggcttttcttgtagagggtaaggaggcaggcagagataagcagaatctgtggaaaggaagctgcacaaacaagggggaatggccagtggggtctgccaggaaattgtcccacagtggtgcgcccattcccaggagaagctgagaagcagggtccattgggaggggaggaatttcgactttttttgatgcttgcccaggctcgggggcaagcagagttaggagcttgtaggaaagaagcctggttcaagtttggctaaagagcattttgttccaattgatcagtggagacaagcagttaggcttgtcatctatgaggcaaagaatgggaatttggagagtgggtgtctggccttctcataggtaaacaggggacatccgtgacttctaagtcatatggggaaggatggttctttgcagtaagccattttccagaaaagccattttccctttggagtaaggggatttcttgacctgcactgctcaccaggatgaggtaaaattcagtattgccagttggcaccatttatgaaacacaccaccttgtaaccactgaattaaatattgcttctgtcatataagttcacaaatatgcttagcttgacctgaactctattttgtgtctgtagtctatttgatttcaagggatttttgttcttgcaaatttattttctaggaattctctgaagtttaaaatcatttaatcaaaaatgaatgctaccaacccgtcccccaccccccgcaaaaaaaaacaaaaacacagcaaaactaaattgttgtgactgggcgaggtggctcatgcctataatcccagcattttgggagcccaaggtgggcaaataacttgaggccagcagttggagaccagcctggccaacatggcgaaaccctgtctttactaaaaaataaaaaaattagccacccgtggtggcaggcacctgtaatcccagctacttgggaggctgaggcaggagaattgcttgaacccaggaggtggaggttgcaatgagtagagatcacgccactgcactccagcctgggcaacagagtgagactctctcaaaaaaaaaaaaaaaaagcaaaccctcaactattgctgggtgaggtggctcacacctgtaatcccagcactttgggaggcccaggcaggcagatcacttgaggtcaggagtttaagaccagcctggccaacatggtgaaaccccatctctactaataatacaaaaattggcacagtgacgcacgcctgtaatcccagctactcgggaggctaaggcaggagaattgcttgaacccgggaggcagaggttgcaatgagctaagatcgtgccactgcactccagcctgggtgacagagcaagactctgtctcaaaaaaaaaaataaataaactattatgattttattggaattatatttatatgaatataatagttggggagatttaatgtttttattacattaagcctttctttgtatctagggattttatgtgtctgtttgattacgtcttatatgctgcaatgatatttataatttttcttcttataaatccatcatctttttatcttttttggttaaatttattttttgcatatttatatttttgttgtcattaagacttatttttgctagtcccatctggttactgctagtataggaataacctatttttgtacttttctcttttatttttattttttgagataggatcttgccttgaagttcactggcatgatcacagctcactgtagccttaaccttccaggctcaaatgatcctccttcctcagcctcccaagtagctgggactacaggtgtgcactaccagacccagctaatttttaaatttttccgtagagataggttctccctatgttgcccaggctggtgtcaaactcctggactcaagtgatcctcccacctcagcctccctaatggctgggactacaggtgataattttatcttgtatccaactccttatcaaaactatctacctattctggtagcttcttattacagttttttcctaggttttctaattgtacagttgtatcagatatagataatatttcctatctgacatttgatatatttcttcttttttcactgtattagctgtctaataaggtagcgtctaagctcattggctatttattttattttttattattattttttgagacagggtctcactctgtcacctaggctggagtgtagtggcacgatctctactcactgcagcctctacctcccaggctcaggtgatcccctcacctcagccctccaagtagctgggactacaggcatgtaccaccacgcccagctaatttttgtatttgtagagacttgatttcaccatgttgcccagactgatctcagactcttgacctcaagggatccacctgccttggcctcccaaagtgctgggattacaggcatgagccaccacgcctggcctgctgtttaaatttaagttaaataaaacttaaaattcggtttctcagttgcctagccacatttcaagtgctcagtacccacatatggctagtggctactgtactggatgatgctaaatatagaaacatttccatcattgcagaatgatggacaatgctgtattggacaatgctgaaatagagcctcagttgtattggacaatgctgagataaatccttcaaaataatgttgagtaatagatgtgatagaaaacatccctatcttgttgccagtgttcatggaaatgatttaaacattttaccgtttagtataaa[135 bp omitted]tcccgggttcaagtgattctcgtgcctcagcctcctgagaagctgggactacagatatacatcaccatgccaggctaatttttatttttatagagatgaggtctcagtctggtctcaaactcccagcttcaagtgatcctcccatcttggcctctcaaagtcctgggattacaggcgtgagccaccctgcccctccagtctctttattttattattattgttatttttagactgagtctcactctattgcccaggctagagtgcagtggcgtgatctcagctcactacaacctccgcctcctgggttcaagtgattctcctgcctcagcctcccaagtagctgggattacaggtgcctgctaccatgcccagctcatttttgtatttctagtagagacagggtttcaccatgttggccaggctagtctcgaactcctgacctcaggtgattcacctgcctcggcctcccagagtgctgggattacaggcatgagccaccacacccagc[132 bp omitted]agaaaccctgtctctactaaaaatacaaaattagccgggcatggtggcggatgcctgtaatcccagctatttgggaggctgaggcaggagaattgcttgaacccaggaggcggaggttgcagtgagccgagatcacgccattgcactccagcccgggcaacaagaacaaaactccatctcaaaaaaaaaaaagtgcttctagtaaataacacataacttttgttttataacccaatgttacagtccctctcttataggagaacccaatccattcagtttatcagtgatatgcctgtttttgtgtgttccatcggactttgtttccttttttcgattttgttattgtttccaccttttcaattttcttacatttgttggctctctcaagcttctgtttattccccttctccctcccttagtaatttggaagttctactctgcttatcaattcttctgatgattatctttccattccttataagcataattcacattttctctattggtagattaagcacacacatgggcgcacacacacacacacacacacacacacacacacacacacaggtgtgttactggcctttactcctaatttctcaggagaatgaaccatttagaatgtttttacctcttcattctgccctcacccaaaatttctgttcttagaaaagaacagatctttttttttctgagttttttttttttttaattagaagagacgctggaagcatgatgacagcagcgtagttttcactctcttgttatgccagcatacagacagagcaaccagatgacaaaatcaaaacccatgggtaatatttacggtgaggccagtagacacagtgtccccagtgtggcagattttctgcagatagggctgccagctgtatttccaaccctgtatgtgtttgccaccctcccatcaagacatggtgcctattttttcatcctttgtgtctgggctggccttgtgttccatttgaccaataaggtatggtagaaatggcattctgggacttctgagcccaaccttaaaagacattgaacttttgctttagtgagaggggaatcaagataccctgtaaagaggtctgtgctgtccttctgaagacagaggtcctggaagatgagacactttttaaaaataggtcatgcagcgctgtggcagccacccagctagctcagttggtagagcatgagactcttaaatataggccatgtacataactgaggccccagctggcagctagcactgaggtctcagtcgtatcatgaaattatcttgcatcctccagtaccattccagcttctccaggcatcatatagagaagaaacaagtctgggcgtggtggttcacacctgtaatcccagcactttggtaggccgaagcaggcagatcatctgaagcagtgaagcaaggagtttgagaccagcctgggtagcaaagcaagacctcatctctactaaaatatattagtcaggcacagtggcacatgctggtagtcccagctactcaggaggctgaggtgggaggattgctgtgcccaggattttgaggctgcagtgagctatgatcgcactactgtactccaatggtcaacagaacaagatcccacctcttaaaaaaaagaagaagaagaagaaacgagccatccccactgagccatgcccagattcgtgagcaataaaatagttattaatccactaagttttggtgtggtttacttacacagcaatagatagctgaaatatccatgaatatcaaaatacacatgagtaagcccaagtcaccaacagccacaacaacttcatggtacaattatctgtataggaaaaagcagggggaagtaagcagtatttgccagacctgagaacacaataccaaaacagccaatgggcatggcagaccaacttgaattcagcagctgaaactgggaggaattttgcaaaattcagcaacgagtgagaggggtctgcaggaaggttggaaggggttggagcagactataataattcctaggaactcttttttctttctttcttttcttttcttttcttggatcatggccggagtgcagtgccatgatcttggctcacctaagcctcaacctcccaggctcaagcaatcctctccccgcagcctcccgaatagctgagactacaggcacatgccatcacactgagctcatttcttaaatttttagtggagacaaagtctagctatgttgcccaggctggtcttgaactcctgagctcaagtgatcctcctgcctcaacttcccaaaatgccaggattacaggcatgagccaccatgcccagccttctatgaactcttaagacggactgtgcttggggggttcccaggaccaacctcaggttcactgattgactatgaaggactcagaattcagcaatggaaaagggcacatagggcagagtccaggggaaacaaggatcaagctttgggttcgcccttcttggtgtagtcatacggccagtgcttaattctcctagcaagatgtggggtaacatacatgaaatattaccaaccatgggctctcactttagcctcggtgtctgtggtttttatttggagtcagtttcaggcatggccaactacctgtgtggttgaccttactcagtccttccaaggttcacgctgatactgcacagcccaagactcaccaagaatcacagctatctggcatggctcatgcactcaagtaaacaaagatttcttaacaggcagtatattccaagggtttagagcagtggtccccaacctttttggcaccagggaccagttttgtggaagacaatctttccatggacatggagcggggtggagggggatggttttgggatgaaactgttccatctcagatcaccaggcgttagattctcataaggagtgtgcaacctagatcccttgcatgcgcagttcacaatagagtttgtgctcctatgagaatctaatgctgccactgatctgacaggaggtggagctcaagcagtatcgctcccttgcctgcttctcacctcctgctgtgcggcccagttcctaacaggccttggactcatactggtctgtggactggcagttggggacccctgacttacaggttatatcccaggagctggggcaagggccaaacctttccttggaatgcacaaggtttaaacaacccagacctcctaagttaattctttactgtatgatgacataccagggctgtcttctaggacagcagaccacactaagaaactactgggagtgaaacaaaaattaagcaagatagggcaatagtaaatgtaattttttttgttttgttttttttctgagatggtcttgctctgttgcccaggctggagtgcagtggtgcgatcatagctcactgcagcctcatcctccccaggctcaagtgatactcccacctcagcttcctgagtagctgagacaacgggtgcatgccatcacagctggctaattttttgtattttttttgtagagatggggtttcactgtgttgcccaggctggtctcaaactcctgggctcaagcagtccacccacctcggcctttgaaattgctgggattataggcattcgccactgcacccagcctctcatgtttgttttgttttgtttttattattatttaattgacaaagaaaaattgtatatatttatggtattaatagaggtagagggaaaaaacagtctttctttcttttctttttttttttgttttttgagatggggtcttgctctgtctcccaggctggagtgcagtggcgtgatcttggctcactacaacctccacctcccgggttcaagcgattctcctgcctcagcctcctgagtagctgggattacaggcacccgccatcatgcccggctaatttttgtatttttgtagagacggggtttta[132 bp omitted]caacataacacttctgacattagattctccagtggataccacctgggtgtcctccaattcaattctgacgctacctgaaaatactgccattagagggctcaataccacaagactgcccccacttcagatgccaattgtaagtcccaggttgtgacctacacgtctgaccaaccagctataaatcaatgaccccctctttgggttcaattaatttgctagagcagctcctagaatttagggaaacattacttacatttacctatttattatcaagggtattacaaaggatgcagatgaatagcagatggaagagatgcatagagtgaggaatgggggaaggggtgcagagcttccatgccctctctagtcatgccaccctctaggaatctcactgtgttcaactatctggaagctcatccaaagccagttcttttgggcttttatggaaacttcattatgtaggcatgattggttatgtaattggccattggtgatcaattcaacattttgcccttctcccctccccagagtttatggtgagtctgcaagtctcaatcctgtaatcatgtcttggtctttctggtgaccatccaccatcctgaggctatctgggggccaccagtcatcatcatctcattagtgtaaaaagtcactcatcactctggagattccaaggcttttaggaactctgtgccaggaaatggggaatgtattagactgttcttgtactgctataaagaaatacctgagactgggtgatttataaagaaaagaggtttaattggctcacagttccacaggctgtacaggaagcatagcggcttctgcttctggggaggcctcaggaaacttacaaccacggcagaagtcaaaggggaagcaggcatgtcttacatggccagcgcatgagggagagagggtggaggttccatacacttttaaacaaccagatcttttgagaacttagcaccaaggggatggtgctaagccattcataagaaactgtctccatgatccagtcaccttccaccagggccctcttccaatactgaggattacaattcaacatgatatttgggcagggacacagatccaaaccatatcaggtgatgaagaccaaatatatatatatcttattataaatcataatatcacaggagcacaacatgatgttatgaaatatgtatacattgtagaatggccaaatcaagctgattaacatatacataacctcaaatatttatctgtggtgagagcccttaaaatctattttcagcagttttcatgtatacaatacattgtatattagcctgttttcatactgctataaagaactgcctgagactgggtaatttataaaggaaagaggtttaattgactcacagttccgcatggctggggaggcctcaggaaacttacaatcatggcagaaggtgaaggggaagcaaggcaccttcctcacaaggcggtagggagaagtgctgagcgaagggggaagaacccataataaaaccatcagctcttgtgagaactcactcactatcatgagaacagcatggaggaaactgcccccatgattcaattacttccacttggtgtctcccttgacacatagggattatgggaattacaattcaagatgagatttaggtgggggcacaaagcttaaccatatcaattgttattaactatagtcaccatgttgtacaatagatctcttgaacttgcatatacatttcctttggctactgtaacaaaataccttaaacttggtggcttgaaacaacagaagtttattttctcatggttataaaggccagaagtctgaaatcaatatcactgggccaaaatcaagtatcagcagggctctgctcccaccagaggctgccaggattccttggcttatggccacatcactccagcctccgcttctgtagtcacattgtcttctcttttgtgccatctccttctacctctctctaataggaacatttatgatggcatttagggctcatctagataattcaggtgatctcctcatggcaagttccttaacttaatcacatctgcaaagtcctttttttggccaaataatatagccaaatatgccaaattatggccaaatactatatcttttagggagtcattattcaacctacacaatccactctgtggttcccaaacattgatgttcatcccacctacaaagtacattcaccctatcccagcaccctcaaaagtgtcaactcattacagcatcgactcaagttcaaaatcttagctaaatatcatcagctcagaagtctcaaatcttatcatgtaaatcaggtttcagtgagactctatggcaacccaggggacaattccccttcatttgtggaccttgtgaaacaagaaaatgagttatctattcccaaaatgtaagcatgggacaggcatcagataacagttatagacattctcattctaaaagggagaaaaattgaaggaattaagaagtcatagttaccaagccactttgaaacccagcaggggagattccattagggttcaaggccttgaaataatcctcagtagttcatgaattgacactatgggcccaaaactccatcccttttattgaagggtagctcaggtttgaagcttagtagttttattgcctgcagaatttttggaatctggaagccttccttcatttcattccatctctgtctctcagtataagctggcaatgtttctgctggcataacattctttgaaaaccttgtggatctcctgtatatgtcacagggattcacactatcaggcaggagggccacaggcttttcctcgttaatctcatctctactcctggcttctgctgtgaagattgagaggatccatgaattacatgcctaatctcttcggtagtagcaaaaagttacccagccatacctttgttctctccagagcatgctttcctaaaagcaaatgtcctaattttagtagctttggcaacctggataggctaagaatttcccatattatcaactcctgattctttctttttctttcttcttttgttttccttttttttttttttttttttttttttttttgagacggagtctcactctgtcacccaggctggagtgcagtggtgcaatcttggctcactgcaatctctgcctccggggttcacgcaattctcagcctccagagcaactggaattacaggtgcgtgccaccacacccggctgatttttatatctttattagagatggggttttgccatgatggccaggctggtcttgaactcctgacctcaagtgattctccttccttggccacccaaagtgtcaggattacaggcgggagccaccgcgcctggccctgattcatttttgcttagcagttcttctctcagtttatcactttcctctcatcacattttaccataagcagcaagaaaaaaccaggctgcacttcaacactttgcttggaaatccccttagctaaataagcaagttcactgcttataagtctgctttcagcataactgtaggacacaattaacttaattgctaagttttctgtcactttataatgaagatcacctttcctatagtttccaataagattttccttcttagccctcaccagcagcacttttaatggtcatatttatactaacatgcttatgatgatacatgtcttctctaagatgatatagactttctctaccatcttctttacttcttctgagtcctcaccagcagtgctttcaacatccatatttctaccaacagggtgttttgggtaatctaggagttttctataatgtttctcaacattcttccagcctctacctattatctaattactctattccaaagccacttccacatttttgggtattttttacagcaacaccccactttcgctaccaaacgtttcctattgctagtgtaacaaattaccacaaacttggtgacttaaaacaacagaaatttatttgttcacaattctagaggccagaaatctaaaatcagtatggctgggccaagatcaaggtgttggcaaggccgtactctcttcattccttggctcttccagctgctggtggccgctggcattccttggcttgtgaccacagcactcgaatctatgcctctgtattcatattttcttctcctatttgtgtcatcttcctctgcctccctcttataacgacacctgtgattgcatttagggcctatgttaataatctagaataatctctccatctcaaaatcttcaacttaatcacaccccaaaagtccttttatcatatggtaacatacacaggttccagagatttctcttggggagtcattattcggcctacctcaataagggaagagactgtctaaataaaagtggggaaacagagccaagaatctcagaaacaagcttccataatttttagcactatgcaaaaacaacagaagagggagctctgacatttgaaaagctaccctgaacccccacctccttctgaaagttcaggaaaactaatttgatataaagaagaatatacagaggacaaatcccatacaatattgctgtaagaataaaaaaataaggggtagaataccattcttggacacaatgaaagaatgccgaaaacacatgctcacagaatggatcaaaattatagccaactattttgaacaagctaaacaacattaagaaaatgatgcaagacaatgaaagaataacataaataagaactagaaaaactcaatttatgatagatctcagaaaatatttggaaataaaagaaaaaatctttcagaatagaaaattaaactgcaaggaacacagagcaaataaacataacacatgatggcttaaaagaaatagaaggtggaaaggatgaacatattttttaaaaagcaaaagaatagtatttgaggacaaatggcaaatatcaaagttataaaaagaagatccaattcatataccctaggagtccttgaagaaaacaagggcaaaaggatgaaaacaaatactaaaaactataattcaagaaaacttcctggaattaaaaaagaattgaaactacatattgaaagagcacatcagacttccttttccttctggccaagatagagttacaggaaccagatttactcttccacttgaaacaactacaaaaatgataaaatatatgaaacaatggggccggccgtggtggcgcatgcctgtaatcccagcacttcgggaggccaaggcgggcagatcacttgaggccaaaagtttgagaccatcctggcacatagcaaaacaccatctctgctaaaaatacaaaaaatagccgggcaaggtggtacacacctgtagtcccagctactcgggaggctgaggcataagaactccttgaacccaggaagcggaggttgcagtgagccgaggttgcagtgagccgagattgcaccactgcattccagcctgggtgacagagtgagagcctgtctcgaaaaaaggaattaaaaaaaaaaaaagaaaagaatgcaggtctgaaaaatatctcaagcaccaatcttaggttttacaatagtgatgttatcaaaaggagcaattgtggaggttaggaattttgtgacctccggccacatgacttctaaaccagaatttctactcttgtggctaatttgttggttttacaaaggctgtttggtccccaggcaaaaagggggtttgttttgggaaagggctgttaccatctttgtttcaaagttgaactataaactaaggctgggcacagtggctcatgtctgtaatcccagcactttaggggtcgaggtgggtggatcacttgaggtcaggggtttgagaccagcctggccaacatgatgaaaccccgtctctaccaaaaaattaaaaaattagacaggcatgttggcacacgcctgtaatcccaaccactcaggaagctgaggcaggagaattgcttgaacccgggaggcagaggttgcagtgagccaagattgtaccattgcactccagcctgggtgacagagtgagaccctgtctcaaaaaaaaaaaaaaattaatatatatatacactaaatttttcctatagttagcttggcctatgcccgggaatgaacaagggcagtttggaggttaagggcaagatggggtcggttagctcagatctctttcactgtcatatttttttcagttataatttttgcaagggcatttcagtattgttattcagagactggttaacgtgggtgcctagaaagggattaacagagcaggcctgagactgttatgctgagaaaagcttgttctcaaggtttgcccttggctggtgtctgggaacttggatttctggagggttcccacttttccctaactgataagggtgtctcactgtgtctacgttgtgctgacaatctggtttatgctggccatctgcctctcttctaggagtctggaatattagtgcgtgctaggcagagggcacctagtgcctaactcccaataaaaacctttgacactgagtctctaatgggcttttctgggcagaaacatgacacgcttgttgctgcatttttgatgctgggggagggtgcactatgtgggagccttcctgggagggaagaagagggaagatggatgagtaaatcatgcctgggtcactatggagttacctatggtgtaaaacagcagctgacctgcttgctatctcttatgagaggtagaagttacccgtggcatttgaaaatgataaatccagtcatagacagttggcttgctggatctcctggctgcttttggccatgctggctaaagataggaagaagtgcagctcaaaggatgactttggtttttgttctctcctccaattgggaggaaaaagggccc[137 bp omitted]atggtgaaatcctgtctctactaaaaatacaaaaattagccgggtgtggtggcatgcacctgcagtctcagctactcaggaggctgaggca[134 bp omitted]accaacgaaaagacaataacagttaattggagttgctctctctcctaggtgggagggggaagggtcagaaaatttctgaaggcaggttttgggtgaatcaagaacgttcaaagtttgcattgctcgctcctccaagtggaagaaaaatagttaaatcagttcccagggctggagcaaggctttagataaaccagaggtggagaaagagtaaaaaacattccccccaaacaagaaaaccactctagccttttctacagcttagtagctgcctctgcaactcaaagccctccttacactgcaaccttcatctccagcagctgtaatgttaaccttgtaaatgcggtgtggaaactaaagcaactccatcttggatgctaatccacgatgttgacttcagattaactccagtgccaggaaggcctctcagatttccagtctagctatctttccttgtgtaagagcacatacttaccacaaatcctgcccttaggtctaaataacctcaatgtgatcgttcttcaattctacacatcacttctgaatcaccccttccctatggtatataagccctgagtctggggttgatggcacagggatccactttctcctcttaccgctacctgagacgcagacatggcttctgtttgcaagtccctattaaatgtttccttctaagaaattggatatgtcagcctctttctttggcctctcagcttcctgggactttgggggtagttttgtatagacctgctcactgtggaacatgctgattttacagctaggggtttggggaaaacagaggggaatgtttattcaaaggctttgtattttgtggctgtcgcatctgggtgtatgataaaatttaatgtaaaatgttatctgctttatttcatcaacattagacaaatcatcctaatagggaaagctgcaaagaaaaaaaaacagtgtttgtggaatcagagctcccttgctttttgctgcctgtgggtggattgcaatttaaactctttgaggattggaaacagaacaagtctccataaccactgatttttgcccattggagcctctggaaaaagggagagaacataaaaagagaggcaatctccgggtagaaacatgctttgggagttttcaaaaacagcttttagtttgctaatgtgctcttgctgccatgaactgcctgacccatagaggctaatggttttcagcctgctgtgcatatgtttgagtaggtctatttggcctctaaaatgaacaagataaaaaggacttttagaaaagtcttgtttgtcacttgggcttggtatacagctgtctggctcttccttgtatcagctttgctgctactgaaggaaagccaggggctttttaaaaatcccagattcacagatcctaattgcctgtgcctgcctctgagctgaaacttgatgctgtcttctgcagctgtttcggccttgcggtgagctgtgcggaactgaaggctcatctcaaagaacaggactcagattctgaattgttgcccatttaagacagcctctgtggggctataaatgacgaaaatacagatgctgaccggattgtctgggtcacataaaaatgccaacaggaaagggtgtggtctcatgaaaccatctaaaattgggtggctgaatggctctagatttctgatacagagactaattgcattcttaacttgtgatttctcttgaaagcttcaggttggggacggacacataacagagaatgtgaccccttcacctacttcacacagattggactggtgcccctctttgagatgtctcattgctgttgacttgttgcatcattcagctttcaggattagatgcagtttgtgccaatggactgatagcctgactctatttccctcacctttcttttctttctttctttctttctttctttctttctttctttctttctttctttttttcttttttttttttttttttagacagggtctcactctgtcacccaggatggagtgcagtggcacgatcatggctcactgcagccttgatctcccgggctcaggtgatcctcctacctcagcctcccaagtagctgggactacaggctcctgccacccagataattttttttttaagagatggggtttcgccatgtttcccaggctggtctcgaactcctgagctcaagcagtccgcccaccttggcctcccaaagtgctggaattacaggcgtgagccactgagcccagcctactaccctcacctttctcctagtgcacacatcttagtgaaacagtttgattattcagtgcagctgtccccagcaagagattgatttttttttccctaggctgctcactgggtaaatgatgaggaggaaaggaatgggaagttaatggaaacccattttgaaaaaattggaaagttccggattcttcctgacctatttctggacatgatatgtctttctggttaaattgcataaaaatattttcctggaaaaatgtttctttccttctagcatataacccttccagacaaatggtctggatgagagtaaaatgattgggaaatatgaagtcatatttcttcagtaagtcatgaagtcttactgaatgagactcactgattttgtaacaatggagaaaaaagaaaagcctatggaggtgccggggtgtagagagtgtattaatgatctttgttttttcagaactgctcctggcagctttcccctctttctgtagaagaatgccccatgtttcatttccaagctgctgtgagtgctttgaatgtaaattggctgctgagcctctgatcacccctgacagcactgactatgacacagcaggggtggcacctgctcctgtgatttgccggcagaacacctgcagatgccatccacacacatgagagggatgaactgatgtcacggataagcaaaactgagggaacctgactacctctgggcagtcccgctgaaaccaaggaccaaactgaattatttggattagactcggtgggagttttccccgtgggaggccacactgggaaccctgttaacctgccctgtctgactaatgtatgccctgctcggggtacctgaacaattgtaaactcttggtttccagggctatcacgtgttccctctgggattgtacttgcatgtgcaccctaactgtcctgacactgcctcagcctggaagacattgacatcagcttcagtttactggccagagtggtgctgagcctgaattgatgtggcaggctgggcaaaaaggggataatacagaaatttaaggaagaagccccctgactttcaaagatgaacttttctggttaatggatttttttttctttgtgtgtgtgtgtgtgtgtgtgtgtgtgtgtgtgtgtgtgtattttgagacagtgtctcactctgttgcccaggctttagtgtagtggtgtgatcagctcactgcagcctcaaactcctgggctcaagtgatcctcccacctcagcctcccaagtagctgggactacaggcgcatgccaccatgcccagctgaattaaaaaaaaatttttttttgtagagatggggggtgtattagggttcccttagagggacataactaataggatatatgtgtatatatataggctgtctgcaagctgaggaacaaggaaagccagtctcaatcccaaaactgaagaacttagagtccgatgttcaagggaaggaagcatccagcacaggagaaagatggaggctaggaggctaggcccatgttgttcttttctcatttttctgcccgcttcatattcgatggaagctgattagattgtgcccaccagattaagggtggatctgccttttccagcccactgactcaaatgttaatctgttttgggcaacacccacacagacacacccaggattaatattttgtatccctcaatccaatcaagttgacaactcagtattaaccatcacagggggtctcactatgttggccaggctgccctccaacccctgggttcaagcaatcctgctgccttggcctcccagagtgctgggattacaggtgtgagccactgtgccccacctggaatttgttttaactggctaaatccaggacccctggagggtataagtgaggttaaatctgcagggtggtctcacctggctgcatggggtcctactgataattttgctgtgaagatgccaggaccaaggggtggactaagcagaagggggttaacatagcagtcctgtaactattgtcctttgaaagtcctgcttacaagcttggcccttggctggcaattaggaacttggatttcgggagtattcccagaattccttaactgataaggatggcttactcttcccaacctgtttgtgcaaacagtggtttctgctgatcaccggctttcattctgggagcctggaattttggtaagcactaggtagagggtgcctagtgaccagcccccagtgaaacctttgggcaccaaacctctaatgggcttccctggggagaagcattatacatgtgttcctggatttttgttgctagaaggacagctctgtgcaagcctcctgcgagggggagacagcatgaggaggcctgtgtacagcatccttcacattctgcctgtgtctttttaccttgacgattctgtcacatatccttttgctgtcataaaccttagctgtgaggacaattatatgctatgctcagtgctatgagttcttccagcaagtcactgaacatggggggtggccctgggaccccccaacagaatgggataaattaataattatgagatattccaattctatcatccctgcgtctatgagaacctgtaattttgttgtgagagaaatggaatgcaggccgggtgtggtggctcatgcctataatccctgtactttgggaggctgaggcgggtggatcacctgaggtcaggagtttgagaccagcctggccaacatgatgaaaccccgtctcaactaaaaatacaaaaaattagtcaggcatggtggcggctgcctgtaatcccagctactcgggaggctgaggcaggagaatcgcttgagcccgggaggcggaggttacagttagctgagatcacgccactgcactccagcctgagtgacagagcgagactccgtctcaaaaaaaaaaaaaaaaaaaaaaagaaatggaatacagatacaatataaaagagagcttaaggaaaaaaaaaacctatattcctgaatttgagttggacatatcaatatgatctcacaacagtttatttttaaaaagaatgtgcacacacacacacacacacacacacacacacacacttcatagctctgtctgctgaagaggcctacaaacaacgaccaacacagcagtaatgagcaaccctggcacccaaattgtggccttgacattccatttcccatgaaaaggaatcagtaccagatctggtactggaaatgtacaagataatcctggaatcttgtcataagagccgatagtgagaaagctgttaatatctattagggtcaagtcaaaagggtgtgggagccaactccaggagtctctcacgggccgcagatgagataatttgagcttcaagaagttaataaatgcaatttgactgaaacctgcctaatatgcttaaattcatgagttcacaatgatctttttaaaaatagttacctttggggaatgatagggaaccaaatcattttcttgaaaactgataaagggacaaagaataaagcatttatgttgcctttcctaaataaactgtagtatcagtaaccaaatgataaatgaacaaaagcatctctataaaagtgttgcaattaataaatgaaaaagaattgttggttggaatttgtatatcaccattttgcaaccaccaatcaatttcatggatcttctaggcattgaagcatctcagctgctaacatcacaagagtgacaaccagacattctgtgccccctgatgagagcacatgtagtcttgctaaaggaattaagcttgaaccagatctggcccctgcattgacctgccaatttgcaggaaacatggagtacagagaaatatattgccatgcacatgcaatcacccaaatccaggctgtgaaaaatccagatttgagtgaggaccttgaaagtaaaagagacttaaaaaacaaatcatttttttttcatgagcaagactaacatgtaatgtttgaggatgtacacttgggtgatataaagaaatgcaaggaagtaattactataaagtcaaggtcaaggttggtgagttgaaattggatggggcttctgggttggctggcagagttctttcttgaatttggtggttgttactaaggtgtttgccttgtaagaaccagttaagctacactttggtgttacacggctttatgtagctatattttattttactttaataaaaataaagtcctgagctattactgttttttt[145 bp omitted]accctgtctctactaaaaatacaaaaattagctgggtgtggtggtgggtgcctgtaatcccagctactcaggagactgaggcaggagaattgcttgagcccaggaggcagaggttgcagtgagcagagatcgcaccattgtgctccagcctgggcaacaaagcaagactccgtctccaaaaacaacaacaacaaacccaaatgcccagtcatcatccatttagattcaattttatgcatatgttgcaggagtcactgcttgatattattttattactcgtttgagatttctcttctaaagtgagagaactttgttgattatttgccttaagtctagaacattactggtaacttctctatacagtattctttgtcgaaaaatatctttgcattgactgataagaattttcatacttatttttaagatgaagtgaaaatgaagcaactttttaatattctcatgcctaaaaagaggaagagctggaattgaaactgtcattaattctacccagattgtcattggtatttccagtattccatcatgactaaaatctagagttaattctcactgaactttgtatactgtattgtatgtagcatagtggcctatatcaaatttaccaggcaaatatatcttttaaacattttaattgtggtaaaatatacacaacattaaatttaccatcttaaccatttttaagtatacagttaagtagtatgaagtatgttcacattgttgtgcaaccaatctccagaactttttcatcttgcaaaactgaaactctgtaccccttaaacaacaactattcatttcccctccccagcccctggtaaccaccattctactttctgtctccataaatttgactactttaggtacttcgtataagcagaatcatacagtagttgtctttctgtgactggcttatttcttttagcataatgtcctaaaggttcatcccagtacaacttttattttatttatttatttattttatttttttgagatgcagtctcactctgtcacccaggctggagtgcaatggcaggatcttggctcactgaaacctctgcctccccagttcaagccattctgcctcagcctcccaagtagttaggatcacaggcatccgccaccacacccggctaatttttgtatttttagtagagatggggtttcaccat[138 bp omitted]caggctagtctccaactcctggcctcaagtgatcctcctgcctcagtctctcaagtcattggaattacaggcatgagccaccatgcctggccacaaacaattttatggggccactttaccaagttcttcccttctgggagggaaagaggccccaccttcctggaaccacagctccacagatggcagaggagggttcccctccctcagagttgtggctcctatgaggtgccatttggccactgccaaggctaccatgagattgcttaggggcctggacacaggagacaagagaaaataaaatagtggaggattttcatactgtctctgagctctaggagttctctttcctatttctcaagccagagctagagggcttccctagatctctgtctgcaccatagtgctcacttctgggcttcaatctgccttaagttcaggctggagaatactggagggggaaaaaaggatgaatactacattttagtgctactgcaaatgttgatcttcttcctcagtcctcctgctatttacttttctgagccctgaaatagctggttctggtattttgtccagattctacagctgaatgaaatctgtgaagtctgtctcccctgcaaggtacagctgctgatgtctctgctcagtgattttttcttgttttgtatccttaaggctggctttctaggggtcatcccctgtctgtacagcttggtgttcaaccgaaggttgatcagaggttgtgttcaatcatgtcaagccatctttgacttgctttgccccggggagcacattcaaacctcaggccttttacaagccagacctggcttttactttctgacaggcttgctcatgtctcctctgtgcatccacaggctcagaaggtcacggatatgggggtggtttgggtctgctgtgatccctgctacccatgtgcatggtctccagtctgcccaagatagagggagactttgtcaagtcctccatggattgcttacattccagatctccatgttcaattcccagcagatcagtccattgcttgccccaaaaaggctgtaaggtgaatctaagggtgctgctggccctctccatttgcttgctgtggagacagttacttaaaatgaccatgctccaaatgcggttagccatctccagcagcggcagtgaagcctgttgttttcatggcctcccttgtcctggttgaaccatggcactgacaaagctggaggaaggataggagccacactgggaaaaagcccaccatagactcactgttctgagccaaagttgagtcgtttcgatgaataaaacacctctcagcttgtacttatgtgttcagctgaattccagaatactgaaagggttgcttttgacacttttccccagcttttagagttgctttccagggagaggacttgccaacctccttactccctcatgccaggagcacaatctgccttatgttttttcttttctttttattaaaaaaaatttggttcggggcggggtctcactatgttgcccaggctggactgggctgaagcgatccacctgcctcagcctcctaaagtgctgggattacaggcatgagccaccgcgcctggccatgccttctattttttttttttttcaatgaaaagagtatattcttttattggtttttgttcatacatgttaagtttcaactttcaataataaaattcaataaatttgattccttaatcataaaaactggctttacacattatttacatgttgtcaaagtccatacaaaacatcacaaggatttgattgactctatgcatggtaccatcacacaggaggagggagctaatccagtaacatacattcaaagattaaattgcagatatgcacagtgtatttggcactgttcattaatattataacaccttcctctcaaagacaggcattcttaagcgttagtcacgatataccagaatttgctattcacattaaaaccaccttttaaactttataacagtaaccgattattatagttttaagaaacaaaacacaatgagaactgggaatggaattcaaatcctccaacttcttgctatgctccaagctgccatccataaaacaggtttaattcggtaatttttccattgtggggagtgtcaacaagaaacaatttaaagacagtattttccaatacaaataaagacacatacttttgtttaaaattaccagttcttcttgggagtgcaaagggagccttgatgatgtacaacttgtgatgcttgtggcaggaattatagaacaaccaatgccattcaagttgtggagattgtactagcaggtgaactcataaagagaaggttctggaatgactacatctgaaatcagaatcctagtagtttgtagtttgcctcttcctagaacttcaatagactcaaatcataggctacagatgtactttcaagtatatacttatgaatggaaggagaaaataaaagcatgaaaatgcaaataataaacctttactggcttgggctatattccagtaggtaatttatttgactaacttaactttaacaacgattaaatcccttcattttaatcaggtccattaaatttcattcattaaagctatacatactccagaatgtttataagacatttatacctatcatgtttacaaaaggcataaattcagtcttcagcggcactacaaatgcctcaatataatataatcacagtataaggaatcagaaattctctgattagatatgctgtagcttcacacaaaactctcagtaataaattaaaacaaaaaaaaaaagtcgtacaatgtataatggattatgcagtgcaaagtaatgtcactggaccaaaatttagtttaatcatttttatttcaagtgtatttaaaaaatcataaatggggtttcataatccaaagttgaaacatttattcttcatagcttcagaatttaacaaccaattgtagaccatgctttccaaatccagtcttctttgctatttttcaaaacttctgagatctagtattaaactgctccattctaaatgtatagttttagataagtattgtacacttgttgataagggttttctgaaaacagtctatcaaatataaagaatggtttctatctaagaatcagcagtgagggaagaaatattaaacacctatcaagaaatcaattattcattttaaaaataacagaaccagtgctgctctctgtcataaaagagaacatgtaaaatttatttttatagactttggtaatattttatttccccacagaggccttcaatcctacttaaagatattttacacacagtaaccatcaggatttactgagtaaaaatctcaggtattaaccatgcccctaaaatgtgctattccaaagaggaacaggttacttttgaggaaaaaagctgccttggtaacttccctcaaatgtttattttaaataaaaatggttgatggaaatattttttaaaagaactttgggtataatatggcatactgcccatcaaacaaaaaaggaaaccaaaactttctttccatttataataagttttccacctttactatcaagattacaacttattgaccttttatgcttgcttggtttttttgactgcctaatccaatgtttaaatttttaaaagtctgcatttcaatgtagtaggagttatttttcaaataatcttcagaacccagaatacagagcaactctcagaataccagagcaacactctcaagtcatacttttgaacccagaataccagaataccagacttcagaacccagaataccagagcaacactctcaagtcatacttttgactacaattaagagatgaaaatggacggatatctgaagataggtattccctctgctctgaaggtgagcaagattttaacatgtgagcaacacagaactccactcctctggagctcctttcaactcagaatgcttcagttcagtaagtcaatatattattcttaaaaattaaagtttggtcactaagaaggactgaacaaaaattattcccctcccgccaaacacaaccagaacagttctaatcaggccctcttctccccacaaaaatagggaagtagctgggctgaagactttaagtgtgacatttcagttcctaaaacatcactgctatttgctcaaagttgtaggtctatgtatttccttctccaatacgtccccatttataagtttatttccatgcatacaaacgtgcacatgtgtgcacgtgcacacccacacacacacactcactctcaagtaagacacttttttgtgtttgttgataaattatgaggattatgaaccaggtgtgtacagggtttcataggtgctttgtaaacatcagagtcacttgggtcctttcctccacaagcctcaaatcaaattacgcaaccaatgaccactactttcccagacgctgttcacaggctgcatattgacgaagggcagagaaaaagtcctcataactgatgtttaggtgggaaggcaaagagacaatctcagtcaatctgatgtgccagggaagaaagcctaatgtgctgtccacaggaccgaacttcaatactaaatcaggatcaggacaaccatttgaactaagtaaactgcctaacgtatctacatccaaatctgtgggtctcttttgcttctgggccactaactggcaaaagtcctgagcagctcttacaatatctgcttttccatcttccggagacagcaccttcactgccaaatggcaatttaaaacttgatcgtctttgtcattactatttgcaaattctggtgagtattttgaacaatctaggcccagaagttcttgctgttgttttaaaatttcatccatcaatctggaattatttcttttgaaaataccttggtggtcgtagacgctaatgtaggagatgcccacggccatacaccacaccacgaggctcgcgatgtccgagaagctgggttcctgctccacctcggtgatcaccaggcccatatgcacaggcagcttctccaaggaacgaccgtccgcgcgccagcgcatccggtggtgtgcggctgccaggcacgaccccccgcgcgggtgccggtggtgacggcggttcctgccgactgccgggggcttgcggagcgtgaagccgagcggcgctaggaccgcggcagaggcggctcggcagcagcgccgccagatccagttccaggtgccgaaccgaacgcggagccaggaggtgagcgtgcggtgcagacagagcagcgcgtgcagcacccgccacaccagctcgtacagccccgtcatactcttgtggccctcggacaacccctctccctcccgcccactcccgcagcgcgacggctttttatccgcccctgcggccgcgcgggccatcgctccgcgtccccccgccccccgagcccgaacccctttccactgccaacatctcacctcgcccccgccgccatcttcccatgccttctattttatacaagcaaaaagaatagaagaaagcagcttacctgccaccagccccaaacctcactttaaaatcaagtcagtccacatggccaaggatgcttgtcttttcacagacatcctcgaaatgaaacatctgctgcctgctaacagcatgatgaagactccaaactttcccatcaaccacacgctctcctggaatacatcactccaccgttatcttcctctatattccagaactgaattctcatgacctttaacctccagtcacttccccaaattggaatgtgtagggcagcagtgaactgcataaccggacctaacatgcttacgaaaacgtctcccactttttcattttcaacctctccattacaagtattcccatccttaagcttggatatagctctatttcattcatatatccaatctgagatcctctttcattattaggtgagttaaatcatttatattcagtgtgagcttttggccttctctctaaagcagtgagtcttttttttttttttttttttttttttttaatgggacaaagtctcgctctgttgctcaggctggagtacagtggggcgcggtcttggctcactgcaacctccacctcctgggttcaagtgattctcctgcatc[134 bp omitted]cagtctcccaaagtgctgagattacaggtgtgagccaccatgccaggctgagccgagagtctagcagtgagtcttaacagggggtggtcttgccccccacgggacattcaggaatatctgtagacgtttgttttgattttcacaatgaggtgctatcagcatctagtttgtagaagccagagatgctgctaaacatcctacaatgcacagtctgctccacccaccacgaaggagttgttatagatgttcaagagtcatatattctatttcttaataattatctcctagagatgcaatcgttgacatttctgggctgtgaatcactggcccagtacacacgctataaatcacctccatagaacaccctgttttctgacttccaaaggctcctaatcactgcttcacacgctcagcaacactgaccccaggatctggtgttgattaacaaacactgatccataatcacttccatctactgtccccccaaaactcacttacttcatccccaaaccccttaattacaaacacttaatcactaagaagcatagatttcataagactaaggccccacccagaccacatggaacaaaagctaccccacaggcaccagtcatatggcctctaaccactgacccctagagcacccatatcccagaagcccaccagtcactatcttgtagcttggaagttgtcactcccatcctcacaagaaaaagagctgaacaaacggaaacaaaacaactcttcccagatttgtcagagaattgagggcacagggcaaactgatgccctgaaaaagtggaaagacagcaatacagagaatcacagcttatcaggagcaggcatgagtaggaaaaggtaaaccaacagatcaactattggagtctgagctgctctcaactactggacatgaagttcctctgtcccctcatccctgccaaaacatggcatgatccagctctccaatttatggcaggtgtaatggggcaggtgtaaataagttgattacatcatgtttccttttatttatttatttttttgagacggagtcttgctctgttgcccaggctgcagtgcagtggcgcaatctcggctcactgcaacctccacctccctggttcaagggattcttctgcctcagcctcccaagtagctgggattacaggcacccaccaccatgcccggctaatttttatatttttagtagagacagggtttcaccatgttggccaggctggtctcgaactcctgaccttaggtgatccgcccgcctcccaggcccggtccagtgtttatctttttgtgactgatttatttcacttagcataatgtcctcaaggttgatccatgttgtagcatgcatcagaatagctcctttttaaggctgaagaatattccattgtatggataaaccattttttatttatctattcatccattgatggacattgcttccatctcatggctattgtggataatgctgctataaggctgggtgcactggctcatgcctgtaatcctagtagtttgggagaccaaggcaggaggattgcttgaggccaggagtttgagacccgcccgggcaacatagcgagactcagtctctatgaaaaatgaaagaattagtcaagcgcactggtgcatgcctgtggtcccagctactagggaagctgaggttggaggattgcttgagcctgggagtttgaggctgcaacgagccatgatcatgctattgtacttcagcctgggaaaaaaaactgcggctatgaacatgagtgtgcaaatatctcttcaagactcggctttcaatgtttttgatatatgctcagaggtgaaattgatgaattatattgtagatctatttttatttttttgaggaagctccaaactgtttcctatcagttgcacaattttacagtcccaccaaaagtgcaccagagttcaaatttctccacattctcaccaacacttgttattttctgtggcttgtctcctgcccctccgcaagcaacaggaaatactagagacagaggcccagccattgactagcaccttagtcaatgccaggccctgactcatccctccatttattccagtcacagtgacaagatgaaggagaaaggacacataggtgtggagaacacaggaagagaggtcctgactggggaggacagtgaggggaattgaattgggggagcttccatttctcacctctactctctcagtttcactgtgagacagagtaaaaccctgtcttaaaaacaaaacaaaacaaaaacaaacaaacaaacaaaaaacaggcgggggcgggcatgatggctcatgcctgtaatcccagaactttgggaggcctagctggaaggatcacttgagcctaggagttcaaagccagcctgggtaacatagtgacaccctgtctctacaaagaattaaaaaaattatccgagtgtggtagcgtgcacctgtggtcccagctactcaggaggctgaggcgggaggatcgcttgagcccaggaggtcaatgctgcagtgagctgtgattgtgccactgcactccatcctgagcaacagagcaaggccttgtctcaaataaataaataaataaaaattaaaagagctcaaataaactgagacagaggttgaaaaatggttacaatgggtaggggttggaggggagatgaaggtctgaggatacaaaatagcagatacctacgatgaacaagtctggaggccaatgtacaacatgaggactaaagttgatacaattgtattagggatttttgctaaataagtggatttcagctgctctcctcacagaaagtaactgtgagatgatagatactatgctaatctgcttcgctatagtaatcattgtactatctacatgtatctagtcatgtacgtatcccatgacattatgttgcaaacctcaactatacacaatagcatttatttaaaaataaaataaaaataggctgggcgctgtggctcatgcctgtaattccaccactttgggaggttgaggtggacagatcacttaaggccaggagttcgagaccagcctggccaacatggtgaaaccccatctctactaaaaatacaaaaatcagctgggcgtggtggcgggcgcctgtaatcccagctacttgggaggctgaggcaggagaattgcttgagcccagaaagcagaggttgcagtgaaccaagatggtgccactgcactccagcctggatgacaaagtaagactctgtttcaaaaataaataaataaaaataaaaataaaatatacacttaatttcaaagtgtgtgatatactttgtagtcacttccaggcactgcctaggctaaaagtcacttccacttggttatattggacccaggatggtgaggaatttgcattcagccctgaccacgtgctccccacatgggtgcaggaggacaaatttgtcaggcagcaccactggatgaagacttggcatcttccggcccaatgtggagacaactctgtcttcatccttctaactgactagggtaggaagagtgatttacagctctagctaccataggcctgagacatatctcataacagaggtgctgggagagccgccttttccccccagaacccacctgcctgcctggcccggggaccgtggggacctgggctccctgggggatggggcagaagtggcagtaaaataaatggagcgagtagaggtgagaaatagaagctccccccatttgattcccctcactctcctccccagtcaggacctctcttcctgtgttctctgcacctgacgtgtcccttctcttccagcttgtcaatgtgaccggaataaatggagggatgagtcagggcctggcattgatcaaggagctgggagggagggtctgggcctctgtctctagtacttcctgttattggcagcaaggcgggagataagtcagacccctgcattcagttgctagagaggtggctgagaggaagtcactgaagggaccaagaagtgacatttgtcattttctctcctgcctccagctttctttggctcacatttccaccctatgccctaggctgccctgacattcagccctgctgccccagtgccctccaggacttgtatccccacccatccattgtacagcaaattctgatccagaatatattaggatgtgaaaccccatgtgttcttgatcttcgatctctaattgccatggttaagatagaaatgacattcttgaggttcatctatttgagagaaagaatctaatctacagctgactgtggctctgcccttccccatctccatttcttgatccttgttaagataatgtagaatttgggattcatatagttatcaatatactgttttatataataatcttttggttcagcctgggcaacatggtgaaactccatctccacaaacaaatataaaaattagctgggtgcagtggtgtgtgtctatagtcccagctactcaagaggctgaggtgggaggatcacttgagccccggaggcagaggttgtggtgagccaagatcacaccactgcaccctagcctgggtgacagagggagagaccctgtctaaaaataacaacaacagcaacgagaataatcctttggtcatatgttgaccaaaggttacagttttataactggatggatatatatatatatatatatatatatatatatatatatattttttttttttttttttttttgagacagggtctcactcttttgcccaggttggagtgcagtggcgaaatctcggctcactgcaacatccgcctcccgggttcaagcgattctcttgcctcaacctactgagtagctgggactacaggcctgtgccaccacgcccagctaatttttgtatttttagtagagatggggtttcctcatgttggccag[131 bp omitted]ttttgtttttgttttaagagacggggtctcactctgttgctcaggcttgtcttgaattcctgggctcaagcgatcctcccacttcggcctcccaaagtgctgggattacaggcacgagccactgctcctggcctcataattatgtttaacctgcttcatttttcactgccaggctcagcagtgtccaatagaaatataacgtgagccacctatgtaattttaaattttcttgaaaccactttataaaaagtaaaaagaaacaagtgaaattaattttaatcatatattttatttaactcaatagctcctaaattgcatcatttcagcatgtaatcaatataaaaatattaatgaaatattttacaatctgacccaacaagctggtagatctgacatgaaaacgtgtctacccattaggatgtctataatttaaaaaaaacatagaaaataacaagtgttggtgagaacgtagagaaattggaaccctggtgcactgcactgttggtgtgattgtaaaatggtgcaactgatatgaaatagtttagaggttcctcaaaaacttaaaactagaaccaccatataatccaacaatttcatttctgagtatacatcaaaagaattgtgcccggcatggtggctcatgcctgtaatcccagtgccctggaaggctgaggcggtgggtggatcgcttgagcccaggaattcaagaccagcctaggcaacatggtgaaaccctgtctctaccaaaaaaaaattaaaaagtttggcaggagtggtggtat[131 bp omitted]cctcgcctcttgagttcaagtgattcttgtgcctcagcctccctagtagctgggattacaggtgcgcgccacacacctggctaatttttatatttttagtagagacggggtttcaccatgttggccaggctggtctcaaactcccgacctgaggtgatccgcccacctcagcctcccaaagtgctaggattataggcgtgagccaccacgccccgccttgggaggatctcttgagctcaggagattgaggctgcagtgagccaagattttgctactgcactccagcctgggcaacagtaaaaccctgtctaaaaaaaaaaaaaagaagaagaagaagaaaaagaattgaaagcagggtcttgaagagatatttgtacacccgtgctcatagcgttatttttatttgaggcagggtcttgttctattgcccaggctggagtgcagtagcgcaatcttggctcactgctaccttgaccttctgggcttaaggaatcctttcacctcagcctcctgagtagctgggaccacagccacacaccaccacatcagactaatttttaaattttttgtagagacaaaaagtcttactatgttgcccaggctggtctcgaactcctgggttcaagtgatcctcccacctagagctcccaaagtgttgggattactggtacgagccactgtgcctggccctccctcacttttttacaagacagtgtctcattctgtctcaaagtgagactgagggaatagaggtgagaaatggaagctccccccatttgattcccctcactcttctccccagttaggacctcttttcctgtattttctgcacctgacgtgtcctttctctttcatcttgtccctgtgactggaataaatggagggatgagtcagggcctggcattgatcaaggagctaggcattgatcaaggagctagaagagagagctgggcctctgtctctagtacttcctgttactggcagaagggcgggagacaagtcatagaaaacaactttcccaaaataaagtgttgacgagaatatggagaaattggaactctggtgcactgttggtgggattgtaaaatggtgcaaccaggctggcgcagtgggtcatgcctgtaatcccagtactttgggaggctgaggtgggtggatcatttgaggttaggagcttgagaccagcctgatcaatatggtgaaaccccatctctgctaaaaatacataaaactagccaggcatggtggtgggtgcctgtaagcccaactactcgggaggctgaggcaggagaatcacttgaacctgggaggcagaggttgcagtgagcgaagattgtgctactgcactccagcttgggcgacagagccagactctatctctaaaaaaataaaataaaatgtgcaaccaataggaaatagtttggagtttcctcaaaaaattaaaaatagaactaccatataactcagccattttacttctgagtatatataaaaaagaattgaaagcagggccttgaagtgatatttgcacacccacattcagagcagcattatttttttctcaagctggagtgcaatggtgtgatcatagctcactgcagcctcaaactctcaggctcaagtgatcttcttgccttggcctcccaaggtgtggggattacaggtgtgagccactgtacccagcctgagctcttttaaaaatattctacatataagtgaagtcatgaaatatttttctgcctgtgtcttaagcaaagctatccttcaaaaatgaaggagaaattaaagtttttccctgacaagaaaaagctgacggaatttatcaccactagaccagtcttaaatgtggatttctaaaccttgctagtcagtttgccaatattttaacttatacctgtagcattttaatgtctattttattccataaagatgtattgggtaccagatgtgtgcttgacacatggttacctgtgggtctttttatttcaatttcatcttttacaccaaaagcttctaggcctgcctccactatccaggtgccctgcactctccattagggtgctggggctagggctcagatgcctagattctcctgagaaccatcagccagggaagaggagttgggaatggaaagctgccttgtttgtccggtacatatgcatatgtagttactggggaattgtagttactgggaaattaaatcagggccaacatgtgcatgtttctaacgtggggatagatttcttcaattcattagatcaattgagagattcttaactgttttgaacagacaaatgttgacaggagtttatttccagaggcatatggactaagagtttaggtctgtggtgtatatcagggtggggattgttaaggaaaagggatatctgggtattaggggaaggggtgcacagatatgtaggaccgacccacaggcctgggtgacatctggacatcgccttaccaaggagccccggtgccctcctcaagccctgcccagctccttttcctgcctggccacagcctgggatgtacctggcttccctttatctataaaaaggaaaggcttccatttattttaatatgaatttatgcacattctacaaaggcattaccacacctgcagaaaaccattgttcgtacttggagggagttttgatgatcattcctgttctgtgtatagttcacatttttacatggagatttctgtgtgtgtatcctgccttttttgctttaatagtacatgaaaataatttcccatgatgttacatagtattgataaacaatttttcaaatggttccataatatttttaaagagactgtctacctgagtttctttaatttcatattccctgtggcttcagatgtttccttttttaaggataatgctttgataagtatctttacacgcgtacgcgcacacacacatccatctctgatccatcaatctatcaaaagaagaggaggatggagaagatggaggaggtgagggaagaggaaaggaggagggctgctccttcacgtcgtgagctctgcgggtggttgcggagcctgggtgaacacgaccgtgaccgtggctgcgaaggcgggccccgccctctgactgcggactacgcggcggcgcctgtgccgcagtagcgctggaccttggcctctggcggtctctggcgccccctcccgttcgcatcgtgaagctgggccgagcccgctgcccgccgttcctcgctcctgtctgcacctcctcctccgttttgcttccctgcagcttttgccccgccccccttcccctgcctccccctggccctccgcgtgttaatttaggggccccaacccggggaacccctcgcagagccagctgctgtcgttaggcccgggtgagtgagcaggacgagagggcacggctggcgacggagcccctcccagcgctgcggcgggagagggggctcagctcgagtcgccacccggactcgccggacccagagctcctctttggggttcccgctctcccgctccccgtgctcctgggaagaggttctggaaacgaccgaatctgggtgcaatcggggtggcgcacaatcgcgcccctccagtcccctctgcgggcagaggaagtgggactcgaggaccagagctctcgggcctcctgatccagggacctgccatttcctggcccaggaccccgggaatgcccgagcatggcacctcgacgtggcaggaaaactgttcaggaggcggcagaggagcctgtgggggacgggaggcagccacctccccgcgtccttcgaaccctttgcttgggctgccgggcatcaataccccaactcacccagcaccccctcttcagaataacctcaaaacccaaccgggctcctggccacagggccttctcttagtccaaccaccaggctgagtgaatcctcgtggagccaggagggtcctcagtgaccctgcacaaacccgttatcaagtcaccccaagtgggatccaattagcatcctgtctcacccagaatcgccacttaccacacctctacctgcctctgtgtgcttggtccccaccatttctcctgcagtcccagactaaggaaggactggacggcccgacccaagcctcccgcaaatgattttaaggaaggagatgcccctcggcagccagacatgaggattgattccaggactcacccagctgctgccccagggaccccacagacttcccaagcagagccagttccctgggagggctgcatggaggaggagacctgccaacactggagccgaggggtttctactgattcattcacaaagcttagatctcagatcttggacacatgactgaacttcacaaagtctcaggatccacacacattttccatttattcttcttattttattttattttttagacggagtcttgctctgtcacccaggctggagtgcagtggtgcgatctcggctcactgcaacctccacctcccgggttccagcaattctcctgcctcagcctcctgagtagctgggattacaggcgcctgccgccacacctggctaattttttgtattttagtagagacggagtttcaccgtgttgcccaggctggtctcaaactcctgagctcaggcaatccacccgcctcggcctcccaaagtgctaggattacagacgtgagccaccagcccagcctccatttattcttctatccacacattcgccaagtacagtcatccctcagtatccaggagaaattggttccaggacccccacggataccaaaacccacggatactcacaccccagatattaaatggtgtagtggttgcatgtaatgcacacatatcctcttgtacactttaaaccatctctagataacttataatacttcatactatgtaaatagttgctatactgtattatttgtattatttttattttattttttttctgaatattttctatctttggttggttgaatctgaggatgcaaaaccaggcatagggtggactggatgttggtcctggtatttgggatgaaaggagagtgagagggcgttcagggcaggaaagaaagaagctggcattacagccgagtgcagtcagggaccttgggaggcctgccaacagcacatgcagaaaagctgggagcactggggcgagttgctcaactccacctgaggggcagaagggggcccggaacgct[131 bp omitted]catggtgaaaccctgtgtccactaaaaatacaaaattagccgggtgtggtggtgggcacctgtaatcccagctactagggagactgaggcaggagaattgcttgaaccaaggaggcggaggttg[135 bp omitted]tttgccaagtagacaaagaaggctgcctgggagcaggggaggtgggtggggggcagtagctggatcacagaggacaacaggaggagcggaggaaatgtttggtcagactggtgtttgggaaggttggccactggcagtgtgtatgcaaggggggacctcagggagcgaaggtgggttaagggggagctcagactggtgtggagccctaacatggacatctatgatctttctgcctttagagggctagttttcaccaagtttccacccgcactgcaacccaatgacaatgtttaaatattctgggtgagtcatttgctaggatttctgcaaaagtatttgattcgatccatttatgaatcaagttgatccttccttccttctttccctccctccctctctcccccccccttccttcctcttccttccttccttccttccttccttcttctgtcttcatttgttgctcaggctggagtgcagtgatacaatcagagctcaccgcagcctggatctcctggactcaagcaatcctcctagctcagcctcctgaatagctaggattacaggtgtgcgccaccatgcccagctaatttttttatcttttgtagagatgggatcttgctatgctgcccaggatggtcttttttttgagacagagtcttgctctgttgcccaggctggagtgcagtggcacaaccatggttcacggcagcctgaacttcctaggcttaagtgatcctcccatctcagcctcttgagtagctgagactacaggcattcaccaccatgcctgactaattttttattttttgtaaaataaaaaggtagatggggtctcgccatgttgcccaggctagtctcgaactcccaggctcaagcaatcctcctgcctcagcctcccaaagtgttgggattgcaggcatgagccagcatgcttggccaccagactggtcttgaactcctgacttcaagtggtcctcctgcctcgggattgcagatgtgagcccctgtgccaggctaagttggtgttctttctttatggattgttatacccccaggagaggctgatagctacccagagttctgcctgtcagtttcgaggtctcatctcagtgacccacaatctctccagctccccagcactgctgagtggaaagagtcttcctgtcttttcccctgccccgggcccaggcagcatccaggtaactgtggggctgaggctggagcaggccaggcccatgaagcaggttggcacctcgagagtttctgcttttcctcagaatctgaggtacttcttggtaatgaggtagagcccaacctccttaaaagtgacatgcttgccagtgcagtttgctaccatttgtgtgtttgaatacagttaaaaattctgtaactttgtctataaagacaaatagacaaaaccaagatctggaagcaaagaaaacagttaggaaatgaaaattataatccaggtgagaggggatgaagacttgaatcaaggcaggaggcgtgggaggcagatgccatatactcttttgcaagcttcttgtgaacatcgaattcgataagctgcagaaaagcagctggcatggtgcctagcatacagtaggcatcaaataagtgctgggttgccacccaccccctccttgaggcaagttctgtcagaaagcaggcccaggggtgttctctgcagagagaagccaggatgaaggccttgttccagctcctcggagacctgtgggtctgaccccacatgcctggcagaagtgcctccattttaactgccttgggccttcttgaccacagtgtgagcgaccacagccccgtcacaggctggtacttggggcctctcccctcctctcacttgtggagagtaggcccaaagttgggcctatgtggccacataagcactccatccttgtcttctctccttggttcttccctactcaccaccaccccaaccaacaagaaaggaagagaaaggtcccaccccacatatattgcctgtcccagtgtttgatagggaaggaggtggtaacactcggtgtgacccccacggaaagacagtcccctcacaccctgagttggtgccacaccatcagctctgcagcgggcactttcagctcctgctgctcctttgccaccaggtctggggtttcactgttctggggctcagtcccatgcctgtcttgtgaggctctggaatcacaggaaagaaacagcgggcttctctgtgctggaggtccccatgtcacagtggcccagggccaggccacgacatgaacactcatgctgcagctaagagtaaaggctcatcatttcatctggaaacattgacctgtttctccatttttccctttaactatctggccacagcaggattcctgggcataagggcataaccctccttgaggttttgctttccaagtgagttgttttattctaaaaatcctacattatactccattttagcattgagtatcattatttcctttctttttattgagacagggtctcagcctgtcacacaggctagagcacagtggcacaatcttggctcactgcagcctcagcctcccccagctcaagtggtcctcctacctcagcctcctgagtagctgggaatacaagcgccaccatgcctggctaattttttgttttttgtttgtttgtttgttggtttttggtagagacggggcttcgccatattgctcaggctggtctcaaactcctgggctcaagcgatcctcccacctcggcctcccaaagtattgggattataggcatgagccaccacacctggccaagtatcattatttctaaaagagactagcactgaggccagattcagtggctcatacctgtaatcccatcactctgagaggctgaggtgggaggattgcttgagcccaggcattcaagaccggcctgggcaacatagggagacttcatatctagaaaaaaaattatatatataaacttagctgggcacgatggtgcatgcctatgggcccagctactcgggaggctgagggctgaggtgggaggatcgctttagcccaggagtttgaggcttcagtgaactatgattgtaccactgcactccagcctgggctacagagcaacctgtctctactacaaataaatttttaaaaagttgcattgaaggaataaggatgaaccaattgaaggaaacacagaggaattttacaaacagagagaccagcaggaatcaagacccagggacataaaccagcaccaggtggtgaagagaccataagcagatcagtgaaaaggctgaaatgggagggggcttgaaagatgggacagttaggacggaccaggataggaacaaccttgactccacttgaaggtgcatgggccactttttggaggtgaggaagaaccactgagtgggtttcagcaggagaacaggggaatatttctctttggatctgatttccctggctacagtgttgaatgactgggagacaaaccagcagagaaggatggattaatctgctcaggctgccataacaacctaccacaaactggggcttccatgacaaaaatgtactgtctcacagttctagaggctgcaagtctgagatcaaggtgttggcagggttggttccttctgggggctgtgagggagaagctgttccaggcctctcctccagctgctggtggttgctgtcgatctttggccttctgtggcctataaaagcatcaccccatctctgccttcatcttcgcatggcattctccctgtgtccgtgtctctgagtccaaagttcccctttttatggccaggtgtggtggcgcacaagtaatcccagcactttgggaggttgaggtgggcagatcactcgaggtcaggagttcgagaccagcctggccaatatggagaaaccccatctctactaaaaatacaaaaagtagccaggcatggtggcgcacgcctgtaatcccagctactcaggaggctgaggcaggagaatcgcttgaatccgggaggcagaggttgcagtgagctgagatcatgccactgcactccagcctggatgacagagccagactgtcaccaaaaaaaaaaaaggcaaaaaatgaaaaaacaaagttcccctttttacaaggacaccactcagattggtttagggctcacacaccactgacctcattttaacttggttacctctgtaaagaccttatctccaaataaggtcacattctgaggcactgggtattaggacttcagcatgtgaatttggcggggggagggacacaattcaacccacaacaaagggggagaatagattaggagcatatgacttgaactacagccacgaaagacggacaaaatagagggcctaggccaggcgcggtggctcacgcctgtactcccagcactttgggaggcctaggtgggtggatcacttgagcccaggagttccagaccagctaggccaacatggtgaaaccctgtctctactaaaaatacaaaaattagccgggcatgatggcatgtgcctgtaatcccagctacttgggaagctgaggtgggagaatcacttgaacccgggaggcggaggttgcagtgagccaagatcttgccactgcactccagcctaggcaacagagtgagactccatccaaaaaaaaaaaaaaaaagagggactagaacagaatcatttgaggatgtaaaatccacaagtcttgttatttcatgaaatgtgggggaaggagagttcaacttctaggtttggagtacttgcatttcagagttatttaagtgttaggaccagaggaggaaaatgagagaggaaggtagaggggacagatcattctagatacatcgagcttgaaatatctgtgggacattcccatagatgaaacaggagagagatcagaaccctaagacatgttcggtagtgagaagtgtgtagatagaagtttaaaacaatgagcaagcactggacacagtggctcacgcctctaatcccagcactttgggaggccaaggcaggtggatcgcttgagcctaggagtttgagaccagcctgggcaacatggtaaaaccgtgtctctacaaaaataacaaaagtttagctgggcatggtggtgcatgcctgtggtcccagctacttggaaggctgaggtgagaggatcacctgagcccgggaggtcgaggctgcagtgagccaagatcgtgccactgcacttcagcctgggtgacagagtgagaccctgtctcataaataaaataaaataaaataatgagcaaggaggtaattgcccaatgaaagcacgcagagagaaggcagagggtcaagaaccaaaggccagggaaccctcaggtatcagggctgtgcttagtatcagaagtttacttaaaaattccaagccaggcacagtggctcatgcctgtaatcccagcactttgggaggctgaggcgggcgggtcatttgaggtcaggagttcgagactagcctggccaacacggtgaaaccgcatctctgctagaaatacaaaaattagttgggcatggtgggatgtgcctgtaatcccagctactcgggaggctgaggcgggagaatcacttgaacccgggaggcggaggttgc[133 bp omitted]caaggtgagtggatcatgaggtcaggagttcaagaccagcctggccaagatggtgaaacccatctctactaaaactacaaaaattagccaagcatggtggcaggcgcctataatcccagctacttgggagactgaggcaggagagtcacttgaacccaggcggcagaggttgcagtgagccaagatgatgccactgcattccaacctgggcgacagagtaagactctgtcttaaaaaaaaaaaattccaaagaggagccaactttccataggaatgttagatctgtgagaacacgaatgctgtctgatttgttcactgctaagtactcaactacctagaacagtgcctggcacagagtaatagttctatgataataataattgtaattattatttaagatgggggtctcgctgtcacccacgctggaatgcagtgatgcaatcacggctcactgcagcctccaactcctaggttcaagcaatcctccagcctcagtctcccaagtagctaggaccacaggtatgcaccaccacgccaggctaatttttaaattttttgtagaaatggggttccaccatgttgcctaggctggtcttgaactcttgagttcaagtgatcctcccaccttggcctcccaaagtgctgggattacaggcctgagccactgcacctggccaattccataattatttgatgaataaaatgttgaatgaactactcagagagaggtgtatgaaaaatcaggagttcagtgtcctgggagccatggaagtgatattatcacctctatcatgcctcacttcaaaaatatcattttatgttactgattttagtgactttaaaatcagctactcctaaaaggtttttttttaaacttgctttgtaacatcatcataaaaacttcagcaaaaagcccaggcaacatagttaaaccctgtctccacaaaaagttttgaaaaattagctgggcatggtggtgtgcacctatagtcccagctacttgggaggccaagatgggaggatcacttgaacccaggagtttgaggctgcagtgagctatgattgcaccattgcactccagccaggatgacagaattagactccgtctctactaaagaaaaaataaaataaaagccggacatgtggcacgggcctgtagtcccagctactcaggaggctgaggcaggaggattgcttgaacccaggagttggaggccacagtgagcaatgattccaccactgcactccagcctaggcaacagggagagaccctgtttcaaaaaaagacaaaaaaaattcaacaaaaaatatttgtgcgtggtgttggaatagatgttattaatatattagatactgttcttcaaatgtagtcttacatgttaatccacaaaaatgatcagataaataaaattactatatactgctttacatgaattgttcatagcagctttatttgtaatagatgaaaacgggaaatgatccaaatgtccatcaacaagtgaatggataaactgtggaacagccatacaatgaaatactactaagcaataaaaaagaatgaatattgacatacacaatgacattgatgaatctcaaaatagtaatgctgcatgaaagaagccacacaagaaagtgcacatactgtatgattccatttatacagaattctagaaagtgccagtgaatctgtggtgacagaaagcagattggtggctgcctggcagacagcggggacagaaaggggcagaacggattacacagaaccaaggaaacttttggaggtgaaggatatgctcggtatcttttctttttttcttttttttttttttttgagacggagttttgttcttgttgcccaggctggagtgcaatggcgcgatcttggctcactgcaacctccgcctcccaggttcaagcaattctcctgcctcagcctcccaagtagctgggattacaggcatgtgccaccacacctggctaattttgtatttttagtagagatggggtttcaccatgttggccaggctggtcttgaactcccgacctcaggtgatccacccgctttggcctcccaaagtgctaggattacaggcatgagccaccacgcctggccatgttcactatcttgactatggtgatggtttcactgatgtgtacatcaaacttatcaaagagtaacctttaaatatatatagtttatcatatgtcaagtataccccaataaagatgatttttaaaatgcatttacccaacaaaagatgcaggcaaaatacatttcagaaaatatagtcagagcaagcttattaccaacagactatcactaaactaacttctaaatggtgtacttgaggcagagtgacagttataccacaagaaaggttggagacgaaaggaagatgaagaccaagaaattgacaagcatgtgggtaaccattatcacctattctgtccaatattttactggaggccttaactagggcaggaagaaaaaagggggatataatgggtgtaaggataggaaaaaaggaaaaaatactgtgattttcagaagttatgattgtctatacacaaaaatcaaagactctacagagaaagttttagaaataagacacttcagcaaagttgctgtaatacagactagatatctcaaaatccattgcattcctatacactagaaataaacatttagaaaatatagttgaggctgggaacagtggcacacgcctgtaatcctagcagtttgggaggccaaggcaggaggattgcttgagcacaggagttccagaccagcctgggcaacatggtgaaaccccatctctacaaaaaaatacaaaaattagctgggtatggtggcacacacctgtggtcccagctttggaggtcaaggcaggagaattgcctgcacccaggagttggaggctgcagtgagctgtgatcatgccactgtgctccagcctgggcgacagagtcagaccctgcctcaaaaagaaaaaaaaagatcagtggttgttaggggctggagggagggagggattaataaacagagcatggaggacttctagggcagtggaactcttctgtatgatacaataatggtggaaacatgcattatacatttgtccaaaccaaacccaaaccacagtaatcaagacagtgtggtattggagaagggatagacacatagaccaatggaacagaatagagaacccagaaatagacccataccaatgtgtccaactgattttttaatttttatttttaattaatttatttttttgttagacacagggtctcactctgtcacctaggctggagtgcagtggcatgatcacaactcactgtagccttgacctcctggactcagatgatcctcccacctcatcctcccaaatagctgggactacaggcgttcagcagcacacctggctattttaaaaaaatttttggtagagatggggtcttgctatgttgtccaggttaccaactgagtctcactctgtcgtccagcctggagtgcagtgacatgatcatggctcactgcagcctcgacctccaggactcaggtgatcctcccacctcagcctcccaagttgctggtactacatgcacacacgaccgtgcctggctgatttttgtatttattgtagagacagggttttgccatgttgcccgggctgggctgccaaccgattctttacaaaggggcaaaagcagttcagtggaacaaacaatgctggagccataggacatccaatagcaaaaacaaacaaacaaaaaccaaaaaaggaacctggacctaaatcacacttagtacaaaaattaactccaaatggatggatcattgacttaaatgtgaagtgtaaaactataatgcttctagggaaaaacctaggactatatatttgggattaagactaggcaaaaagaattcagaagataaaaaccacaattcataaacgggaaatttgatcattagaaacttttgctctgtgaaaagacaagctataggctgcgagaaaatatttgtaaatgacatattcgacaaaaggctagtatctacaatataaaaagaactctcaaaactcaacagtaaagaagcaaacaatccctttagaaaattggcaaaagatgcgaagagacatttcactgaatgggatgtacagatggcaaatatccacatgaaaagatgttcaatatcactcgccattaagaaaatgcaaattaggccaagtgtggtggctcacgcctgtaatcccatcactatgggaggctgacgtgggcagatcacctgagctcaggagttcgagaccagtctggccaacatagtaaaaccctgtattttttttctactaaaaatagaaaaattagcccggcgtggtggtgcgcacctgtagtcccagctactggggaagctggggcaggagaattgcttgagcccaacaggcagaggttgtagtgagccgagattgcaccactgcactccagcctgggcgacaaagtgagactccatctcaaaaaaaaaaaaaaaaaaagaaagaaagaaagaaagaaaaagaaaagaaaatacaaattaaaaccacaatcagctatcagtcatgaatatcagaatggctaaaattaaaaaaaaaaaaacagtgacaatacgagatgctggccaggatgcagagaaaacggatcactcatgcatggcaggtgggaatgtaaaatgatccagacagtctggtagcttcttacaaactaaacatgcaattaccatataacctagcaattgcactcttgggcagttatcctagagaaatgaaaacctatattcacataaaaacctgtacattaatgttcatagcagctatgttagaaataatgaaagactggaaacaacccagacattcttcaataggtggatggttaaacaaaccatggtacatccatactgtggaatactattcaacaagaaaaaggaataagatgggctgggcgcagtggctcatgcctgttatctcagcaccttgggaggctgaggtaggtggatcacttgagcccaggagttcgagaccagcctgggcaacatggcaaaaccccgtctctacaaaaaatacaaaaattaccctggtgtggtggtttgcacctgtagtcccagctatctgggaggttgattgaggtgggaggatcacttgagcccgggagggggaggttgcagtgagccgtgatcgtgccactacactccagcctgagtgacagagtgagaccctgtttcaaaaaaagaagaaaaaaaaaggtacaagatgttgatacatgcagcaacttggatgaatctccagggaactatgctgagtgaaaaaagtcaaatccaacagttcacatattgtataattcaagttctataacagtcgtgaaatgacaacattctagagatagagaacagattagtgtcagggattaggaacctggaggggatacacggcaggcactagtgtagcaggtgtggttgcgaaagggcagcaggagacatcccggggttgtgtcaatggccacatcctggttgtgatattgtgctgttattctggaaggtgtcaccattggaggaaactgggtgaagggcacataggatctctctgtattattcttgcaattgcatgggaattgacactgatctcaaaatcaaagtttaatttttaaaaatgtgcagctcacctaggatgattgtataactggtttagaccatggctacatagaattaaccagagagtggtgagaacaaggtggggcaggaaggaatcttctggacacagaagagaacaacaagcaagaacgtggtggtgggagccacactgcctgggttagaatcttggctctggcccacactcgtgctgtgttcctggctaagttactgccttcctccaagcctgtctccttatctgtgaaatgtaggtgagttcatatgtggagtcgcttagggcagcacttgatacagagctagcactcaagggtttgttattctttctatcatttcacctaggaaggatgtgctcaactggaaatgctaggtggacttacagtaacaccgtaaaatccatcatgtgaatgtttagctcatgagaatttcactcttcatgctctggggtaactaacatatattctacatactcacttgtatgactattcagatctgctgcagtacttcattcttctccatcgctatcccaatttatgtgatgaaaagaatataaattttttaaaataaaaaataacctataactcatagaataaaatagggaaccatgagtccatactgatataaataaatgaatacattgaaaatttgatgaggaacagaatgtttacaagatctcaaagtgcctttccgcaaactactgattttttaaaataatttaatatattttatttaatccattatatccaaaatgttatcatttcaccatgtaatcaatataaaaagttgagataaggctgggcgcagtggctcacatgtgtaatcccagcactttgggaggccgaggcaggcggatcacctgaggtcaggagtttgagactggcctgaccaacatggtgaaatcctgtctctactaaaactacaaagaaaaaccggccaggtgctgtggctcatgcctgtaatcccagtactttgggaggccaaggcgggcggatcatgaggttaagagatcgagaccatcctggccaacatggtgaaaccccgtctctattaaaagtataaacattagctgggtgtggtggcgggcacctgtagtctcagctactcgggaggctgaggcaggagaatcgcttgaacctgggaggcggaggttacagtgagccgagatcacgccattgcactccagcctgggcatctttaaaaaaaaagtgcaaatatttatttttacttatttacttacaaatttttctttagagatggggtgatatagtttgaatatatgtccttgccaaagctcatgttgaattgtaatcctcaatgtttgaggtagggcctggtgggaggtgattgggtcatgggggcagatccttcatggcttggtgctgtcctcgctatagtgagtgggttcacttcacgagatatttggttgtttaaagtgtgtggcacctccccaccctttgctctcgctctgccatgtgagatacctgttcccactttggcttccgtcatgagtaaaagctccttgaggcctccccaggctccttcctgtacagtcctgtataaaactgtgagccaattaagcctcttttctttataaattacccggtctcaggtatttctttatagcaatgcaagactgacctaattcacggacagggtctccctctgttgcccaggctggcgtagtggcttgatctcggctcattgcaacctctgcctcccaggttcaagcagtcctcctacctcagcctctggagtagctgagattacaggtgctagccatcatgcccagttaagtgcaatatttaaagggttctgaaaattttcttcctttgaaagctttcactaactgagaacttcaaagtgctattttcctgagaaattcaaataactttcaattatttctagggtcccctagcagttacttggggaaataaaaaagaaaattcaatgtctatcttactcctcatgccaaaataaatttcatctggatagaagctttgaatgtaaaacaaaaaaaataaataaataaaaaataaaaccaatcaacaaacttgggagta[137 bp omitted]tgcctaagcctcccaagtagctgggactacaggtgcccaccaccacgcctgactaattttttttttttgtatttttagtagagatgtggtttcaccatgtcgcccaggatggtctcatactcctgagctcaggcaatccacctgccttggcctcccaaagtgccaggattacaggcatgagccaccacgcccagccagggaaaatatttttataattgacaaattagaagtcacgaaaaaaaagcaatgaattaggccccccaaaattttaattctttgcatgtgctttggaacattttgctgatcttataccaagataatttttttaaggaaaatgagatcagtgagtacttactgctctgcaagctatttttattcacttggcagtaaaataatggcatctttccaagtgagtgcatttgttttaatggatgtattagtatctcattatataaaagtctatatttagatattaccctcttctcttttgttaatatcttaactaactaggttatatgaggagcaaagaatgagcctacacccagcacctaaaccaatggtttcatgacattctctgctccaacatgtggctagagacaagtgattctgagaagaaaactgccaaatcacagaacaagtttacactactccaggtggataggaagtttaatatttaaaaaaaaaaacaggctgggtgcggtggctcatgggtgtatcccagcactttgggagaccaaggacagaagatgacttgagcccaggagtctgggaccagcctgggcaacatagggagatcctcgtctttacaaagataataaaaaatattagccaggcatggtggtgcacgcctgtagtcccagctactggtgggggagctgaggtggtggtggggctgcagttggtgggggggatgatgaggtgagaggatggcttgagcctgtgagttcaagcctgcagtgagctatgatagcgccactgcactccagtctaggtgacagagcgagatcttgtcccaaaataataataataataataataaaaacaaataaaaaacaaaagttcatttagattttgaagataataaacgtatgaatatttaaaattacacagttttgctttccagagtgatgataaaagtgtaccatttgagtcactaactcttttttttctttttaagagagtctcgctctgtctagcaggatgcagtgcagtggcacgatctcagctcactaaaacctccgcctccagggttcaagcaattctcttacctctcaacctctcgagtagctggtatgactggtgtgcaccaccacccacctcagcctcacacagtgctgggattacaggcgtgagccactgtgcccggcccattttagtcattaacttttaaaaataaacttcacacagcagtacatctcagatgtttataacaaaaaggagggtggatgtgtgtgtggggggtgagctttctaatttgaccacgtcaatattgtatctgccaagcagtttccaacttgtatcaagtcaaatgagtacttagttgttttctttagttcttagaatatttcccctacattctccatggctcggttctttccagaaaattccctggatggaattttccacatagcccagcagagggccctgtattctgagccacagtcaggcatacacagaagacactgcagacaccaatcagcaaatcaggaacgagaattcctctcctcccacactccagccaaagggctctcaggttccagttgcagccggtcagctaacaactgacggtgtctgcacttccttttagtctaggcggcggtagaaatggtttctaagaatacccagtggctctggaaaacatttccatcatgtgaatgagcctgcgcgtattttatattacagcttttattcccctcagattcctattctcattttaaaatgtatttaaaagatatagagacatataaagccttcagaggaaaatgcattaaaaaggaatatatcacaatggtaaaccatgattactactaaagagattatggcttatttcactccattctttaatttcccagattttacaccattatcgtgtttcttttattttgaatattctcttttcagaaagagaaaatatagtttgaaaaagcggctgggtgtggtggctcatgcctttaatcccagcactttgggaggccaaggtgggtggattatttgaggtcaggagttcgggaccagcctggccaacatggtgaaaccctctctctacaaaaatacgaaacttagctgggtgtggtgtcgggcgcctgtaatcccagctactcgggaggctgaggaacgaaaattgcttgaacccgggaggcggtggttgcagtgagccgagatcgcgccactgcactccagtctgtctcaaaacaaacaaacaaacaacaacaaaaaggcaagagacaggaagtaaatatatgcccatcaaaaagattaaaaacacttggagcaatttttaaaaatctgtattaaaagaatttttagaacataagtgggtgcttatgtgtaaaataatatacaagaaagtaatttatttagcctatatatatataactgatcattttaacccttgtagccaaaaagtagaagcacccacttatgtgcagagggtacagatatcttttccagaaagaaatgaaaaacactgcaccatgaagtgccgttatttttatcttgatttcaaggaagagaagaccctgtctgatgactttctgtcattaaagtatattttgaatgaaaggatcatttacccatttattccacaaatatttagagattcagatacttttcataccatgaactccccaaccctccgaagaaaaagggacctcatctagatcacaagcccctcttcttaggaaactggaactgttactatcactccaaccccagctgtcacttggctaagccccactcattctttagtcctccaactattcttcagggagacctcatctccttggaccttaactggcctctgccctctgggcattgccttcctcagtacccgtggatgggcccagtcatcaaacccattgcagacacggagggcttctctaaactgtgagtacaaggaagggccaggaaacccttgagccaaacctgctgacatggaagtcctatgtacatatatgtagacatacagaataagtatgtttgtaggcattctttagttccaagataggggatttcttctct[225 bp omitted]gaggcacaaggatctcttaaacccagatggtggaggttgcagtaagccaagatcgcaccactgcactccagcctgagcgacagagcga[177 bp omitted]ccaggcgtggtggcgtgtgcctgtaatcctagctgctttggaggctgagacaggagaactgcttgaacccaggaggcggaggttgcggtgagccaagattgagccattgcactccagcctgggcgacaaagcgagactctgcctctaaataaataaataaataataaaataaaatgcttattttgaaataatttcaaacagaaaacttgtaagaatagaacaaagaactgtatatcctctatccagattcctcacttgctaaaattttaccctgtatgcttttgtttagagatagtctccctgtgtcatccagactggggtgcaggggtgtgatcacagctcaccgcagcctcaacctcctgggctcaagagatctcacctcagcttctcaagtagctgggaccgcaggcgggcaaccaccacacccagctaatttttaatttttttgtagagacgggatctcactctgttgtgcaggctggtcttgaactcctgggctcaagcaatccttccaccttggcctcccaaattgctgggattacaggcgtgagccattgcacttggctgctagttttctcaatcagaagtggtcgaggtaacctgtaaataaggattaaaaatttaagatgttctaaaataaaaagaagaaattagctattaagccatgaaaagactcaggtgatatttaaatgaatattgttaagtgaaagaagccagtttaaaaggttacatactgtgattccaagtatatgacatttctggaaaaggtgaaactgatgagggaataaaagatcagtggttggctgggcatgatggctcatgcctgtaatcccagcattttgggaggctgaggcggaaggatcacttgaggccaagacttcaagaccagcctgggcaacatagtgagactccatctctataataaataaataattggtggttgcttggggttccagggaagggatggaaatttttagttttattaataatttgtaaatattaatatatgtggtgtgtggcttctatttggattcttactttaggacctgtgaggggtgggcttagaatattgcatagatgggccgggcgctgtggttcacgcctgtaattccaccactttgggaggccgaggtggacggatcatgaggtcaggagttcaagaccagcctggccaacatagtgaaatcccatctctacaaatacaaaataatacaaatacaaaaacacaaaaaaattagccgggcatggtggtgggcgcctgtagtcccagctactggggaggctgaggcagga[148 bp omitted]gttccaccagatgtcagagcacatataacttagcacagcatggtactgctgcagggatagacaagcagataaatgaaggtggatggaaagcacagcagcatgcccagcatggacccttggtctatgatcaaggtgttattacagatcaatggggaagggcagacctttcaaaacagtggttctgagctgggtgaggtggcttatgcctggaatcccagtgctttgggaggctggggcgggaggattgtttgaggccaggagctcaagaccagccttggcaacatggtgaaaccctgtctctacaaacaataagaaaattacctggatgtggtggcgtgtacctgtagtcccagctactcaggatgctgaggtgggagggtcacttgagcccagttgttcaaggttatagtgagctatgactgcactactgcactccagcctgggtgacagagtgagaccctgtctaaaaaaaaaaaaaaaatctgagcccaattgcatatctatagggaaaaataaataaataaaattggttccctattgcacactatccaccaaacatcaactcacaggatattatagatctgaacatgaaaggcagaactaggcccagtatggtggctcatgcctgtaatcccagcacttagggaggctgagatggggggatcacttgagctcaggagttcaagaccagcctgggcaacatagtgagacctcatctcaactgaaaatttaaaaatcagttgggcctagtggcatgcacctgtagtcccagctactcgggaggctgaggcaccagaatcacttgaacctgtaaggcagaggttgcagtgaaccatggctgcgccactgcactccaacctggatgacagagtgagacagtgtctcagaaaaaaaaaaaaaaaagagaaagaaagaaaggcagaactaactgtaaagcctttagtaaataatggagttttgtaaatcaatataaaaagaagaaacacaatggaaaagaataactatcagcaactcacagtgaaggaagttcagatgacatctaaacatgtgaaaaagggctctgtctcactagaaacaaggaaattgcacattaaaaccacaataagattgtcaaacatggccaggcgcggtggctcacgcccataatcctagcactttgggaggccgaggctggcggatcacgatgtcaggagattgagaccatcctggccaacatggtaaaaccccgtctctactaaaaatacaaaaattagctgggcgtggtggtaggcgcctgtaatcccagctactcgggaggctgaggcgggagaatagcttgaaccagggagtcagaggttgcagtgagccaagatcgcaccactgcactctagcttggtgacagagccagactccatctcaaaaaaaaaaaagattgtcaaacatgtaaaagtctgatggaactgtcaataggtgtattgtcattggaaatagcttggcgatatctattaactttaaggatacacactctctatcagccagagatgcaaacacatgtccacagagcctaaggaggcatctctttactatgtgggtcatgccagtgcaggatttctctaaatattttagttggtgcacagatcttaaaccccagtgatttgacccgtgggagcccatttctaacatccacaagctaataacaaacactaatgttgcaaatgaaaagacatttaaaatgctcattttacaaattatcaaagcctccagtgttgcatggtagataaacaactattagtagccttccacagtgacacctttctttttttttttttttttgagactgagtctcactctgtcacccaggctggagtgcagtggcatgatctcggctcactgcaacctctgcctcccgggttcaagtgattctcatgcctcagcctcctgagtagctgggattacaagcatgggccaccacacccggctaatttttgtatttttattagagacggtttcaccacgttggccaggctggtctcgaactcctggcttcaagtgatccacccgcctgggcctcccaaagtgctgggattacaggcatgagccactgcgcccagcccacagtgagacctttctaatcaaatgtcagctcactgtgcatggttaggaactcccaattagaatgacttgttgtcctcaggtgtcaattaagaccaacctacctgaggcagacactctgatgtgcctcctggatcccacttcaagcaggggcttgtttttccagcactggcagtgctgtgagcagatagctctcaattgccagccccttcaggagtggcctcagctgcggaaagcctccttgtgcaagggcatacccttcccagggcagtccacatccacaattgatcaatgaggggatacgaaggcctggtcatcttcagccagctcgagaaatctctgatggaccaacgtagctccagaactttcctgcaggatcatccaaggctgtgctagggactgtatcatagctgtatggtccctctgtccaatcctacctcttccgctttccttcacatgcattgatagcaagtaaacagtctgtgcgctcaactccatctcagagccggctggttagaaaaaccaacctcccagcactttggaaggccga[133 bp omitted]gaggcaggagaatcacttgaacccaggaagcagaggtttcagtgagctgagatcatgccactgcactccagcctgggtgacagagcgagactccatctcaaaaaaaaaaaaaagaaaaaccaacctgcaatatctcctttttatcttgctgcctatgctgtaaggttttaaaggaaatgataaacattgtgactacctgattagatggatgagtctttggcttcaaggtacatggtttcagagctgggcgtggtggctcatgcctgaaatcccagcgcttggggaagctgaggtgggaggatcacttgagcccaggaatttgagaccagcctgagcaacacagtgagacctcatctgtacagaaaattaaaaaattaactgggcctggttgtgcacgcctgtagtcccagctactgagactccagaggctgagttgggaggatcccttgagcccagcagtctgaggcttcagtgagccgtgatcatgccactacactccagcctgggtgacagagcaagaccctgtctcaaaaagtacatggtttcaacaaacttatgtatataatataaagttaatattatatatctagattacacctcaagttgcaaactttcagcctactgtgaaatgtgtgcattttgaatgaagatacaaatggaaaaagttatttaactcagcttggttttctattagtttgcacaaatacaaagtcactcagactgttggataaaacatgaaaacctgccctctagttgtaaaaatatatatatattgctctagaaattgaga[139 bp omitted]atggtgaaaccccatctctactgaaaatacaaaaattagctgggagtggtggtaggcacctgtagtcccagctacttgggaggcagaggcagaagaattgcttgaacccaggaggtagaggttgcagtgagccgagattgtgccactgtactctagcctgggcaacagagccagacttcgtctcaaaaaaaaaaaaaaaaaaaaagatgtcatttctcacaagagctccactttttaaacaggaagtttaagtgaaactcactcttctgtggcattctcaatagattcagtaccatgtttttagcatcaatcaaaatcattctaatattataatacagatgacattgtttcaggaacaagattgggataaaagagtaaacacagatttagaggagctagggtaggcctgctgtgaaagacagatctaggacccctcattctgtccctaccgagttcagctttctcatccttgggaccagggagggagaaaagaggttcttattttccatatctgctgaaccttgactttgtcagcttttgcctggactgatcccaacttcagacaccccactctacatttgtgccacaagacatctctttttccttctgtattgaaaaagagt[132 bp omitted]taaaaccctgtctctacaaaaatacaaaaattagccgggtgtggtggtgggtgcctgtaatctcagctacttgggaggctgaggcaggagaatcacttgaacctgggaggcagaggttgcagtgagccgagatcgcaccactgcactctagcctgggtgataagagcgaaactccatctcaaaaaaaaaaaaaatttagacttgaaaattaggcatcgcctataaaatgtcaaaggttgtcaggtgagtgcatttgcggatatcagtaacttattgttttttagtgatttcccaaggaaacataaaagacatttgaatattttccttccatgcccctggataacatcatctttgatcatggagttattgagaacttgaatctgagacaaaaaatgttgtgtaatctagaggaaagaaacgttcccagatcagttttttgttttgttttgttttgtttttgagacagggtcttgctctttcaccaggctggggtgcagtggcctgatcatagcccactgcagcctcaatctcccatgctgaagcaatcctcaggcctcagcctcccaagtagctaggactacaggtgtgtgccaccatgcccagctaattttttgatttcttgtagagatggggtttcactttgttgcccagactggtcttgaactcctgggctcaagcagtcctcctgccttggcctcccacagtgctgggtttacaggtgtgagccaccttaaacaagatcccatccttgaacaagaaatatggtgtattacttgcttgggctgccatgacaaaatacacagagacttgggggcttaaacaatagacatttattttctcatagttctggaggcaggtacaggcaaggtagatttattctgaggctacttgtctgggtttgtaggtggccgctctctcgctgtgtgctcaggtgacctcttttttgggcatgagaggggacgaggtcttggtgtctttttttatgaggacaccagtccctcagatcggcatcccactcttatgacctcattaaaccttaattgcttctttagaggccctatctccaaatatagccacactaggggttagagtttcccacatatgagttttgggactcaaacattgagtccataacatggttaaggtgccttcattctctaccataaataacaagctaaatgtactagacacacctgttccccataaatatattggtaacatttcattagatattaaagctgaggatgaaattctatagcatagtactttttattccagagggctcagagaatattctctctatgcctaaagatatttatgtttcatataaaagaggtgactggtgccaggtgcggtggctcatgcttgtaatcccagcacttcgggaggctgaggcaggcggatcacgaggtcaggagtttgagaccagcctgaccaacatggtgaaaccccgtctctactaaaaataccaaaattagccaggcgtggtggcgctcacctgtaaacccagctaatcaggaagctgagacaggagaatcgcttgaacccgggaggtggaggttgcagtgagccgagattgtgccactgcactccagcctgggggatagagcgagactccgtctcaaaaaaagaaaaaaataaataaaaaaaaagaggtgactgacagaaatattgtgctgaagtatattgtgtatctagactgtttctttttgaaccagaataggttcagagaggcttcttgtagactatttctacaccaagcatttaactgctagtctagaattaattaaacccagggttgacagacagtccttctcaagagaaaagatactctgtgtagagaaacttctcctgccagtgtgaaagaagccaaaagttttggggtaaacagcagcttttaaacagactttggggccgggcacggtggctcatgcttgtaatcccagcactttgggaggctgaggagggcggattatttgaggtcaggagtttcagaccagcctggccaacatggtgaaaccctgtctctactaaaaatacaaaaattagccgggcctggtggcacgcac[137 bp omitted]atgcaatggctcacgcctataatcccaacatttttgggaggctgaggtaggaggatagcttgagcccaggagtttgagatcagcctgggcaacatagggagaccctgtctctatgaaaaaaaaaaaaagtaatcgtggtggggggtggcacgtgccttgtaatcctagctactcaggaggctgaggtgggaggatcacttgagcctagaagtttgaggctgcagcgagccatgattgtgccactgcactccagtcttggtgaccagagtgagtccctatctcaaaaaagaaagaaagaaagaaactttggccagagttatatcattactttgagaaaagcacccaaggtattggttttgcagattgtgcggagtcattaagaaaaggaacaggcacttctgcttctagccaaaatcaattaacagggaccaaatgtaacttcccatctgaaacagccaaaaaatcccagactatgtaagtgaaacaaaggttttaaagacactggatatcaggcaatgtaggacagtggcccctgagaaatgggaaataaacaaggtgagccctatgactgtcgcagctcactgccgtgataagggatagagtttccaggccatagcacagagaggaggaattgaggtgaaatctggtagactccttgaatcgaatacatttctttgtcataatattgtactatagttttgcaatatgttattatggggggaatttggcaaaaggatacactaatctctctgtgttcttttctcttcttttctcgatgggaaggtgggggtggggacagggtctgttgcccaggctggagtacagtggtgtgatcacacccattgcagccttgacctcctgggctcaattgatcctcccacctcagcctcctgagtagctgggactacaggtgtgtgccacggggaaaaatacactgtattaacaccggtgaaaagaaagctggggtagctatacaaatatcacacaatttagattccagagcaaaaaatatataatggaaaagaaggccattccataatgataaagcagtcaattaatcaagagaacataacaatgctaaacacttatgtacctggccaggtgtggtggctcacgcctgtaatctcagcactttgggaggccaagataggtggatcacctgaggtcaggagttcgagaccagcctggccaacatggtgaaaccccgtctgtactaaaaatacaaaaattagccaggtgtggtggcgcatacctgtagtcctagctactcgggaggctgaggcaggagaatcgcttgaatccgggaggcagaggttgcagtgagccgatatcacgccactgcactccagcctgggtaacagagtgagactcagtctcaaaaaaataaaaaataaaaataaaaaaaacaaaagacacttatgcacctaaaacagagcttcaaattacatgaagcaaagccaacagaattgcagggaga[450 bp omitted]tagaggtgcacaccccaatgcccagctaattaattttttttttttgtagagatgggacctcactatgttgcccaggttggtcttcaactcctggtctcaagtgattcttccacctcgctgcccaaggtgctgggattacaggtgtgagtcactccaccccacctcttcctcttcatttttttttttttttgtttgtttttgaattttgctcttgtcgcccaggctagagtgcaatagcg[132 bp omitted]ttggattaggaccccaccattatgaactcatttaaccttaatttcctcttttaaaggccctatctcaaaatacagtcacactgggggttaaggcttcaacatgtaatttttggggaaacacaatttagtccataacaaacactactggccagcactggctgacctgggtacctgcaggccaccaggattgctaaaacatctgtcgatgctgtgactgaaccttctgaaatgaaactagacttcattttggattattggggtgtttattcttgtgtaatcttatcagtgtccttgaacttggatcattcaataagtactgccaagggacatagatatttgctttgatactttaataatttcagtggtgatgacagtgataacaggaacagttaataagtactacacagtcactatgcatcaggcattctgtaaagtttgatgcagattagttcacagaatcttacaagaaccctatggtgaaaatacttttagaaaatattaaagatgttaaagcctataatcagttgacttaaagttaaaaaaaaattaaagatgaaacagacaccaagagaagaaacagcttgtccaagatcgcacagttattaatacatagcaggacctgaggatattcacacacactaactagataagtggtcaagtattaaggcattctgggtaacttcagaattgattttctcataccacatcatggtaggcaacatttacatgggtgacaaaaactattgcaagctattttatactatatacagagaggactacatgttatattatatcaataatgatatagcaaagacaacatgtggttcacttatccagaaaaaatgaaaattatttggagtatatttgaaatttcatttacaataattttataaattgaatcaaaatttattaaatatagatgatgtaaaccaacagatattacacttttttttctcctatgatgggtggtgaaatctactgtgggtcagtgtatatgtgcttggaataaatgtgtaaaccttgagaaaatttttacaaagtgtatttctgattgaaaccaaaagaagacatttcagaattccttgtttggtggaaatgctttttgtttctttgtttaattaattacactttaaaaataattgctgaccatactgaattgcaatccctaccaagggagctaccagggagggagagaggtgtctgtcactgtccatggcatcttaaaggttgcccccactgctcagtgtttgtttatgggttcatattgatccctttgcttaactagtaaatattttcctatttgagaaataatcatacttagcacagaatgtcctcatcagagtaaatctttaataataaaattatacgactgttatttggtttaatcatgtttttccactcatctgatccttgggtttggaagtggaaaatatatcagcctgcactttttttttttttttaaaggagtctcgctgtgtcgcccaggctggagtgcagtggcgtgatcttggctcactgcaaactctgcctcccgggttcacaccattctcctgcctcagcctcctgagtagctgggactacaggtgtccaccacca[160 bp omitted]acatataatgaacttaaaaaaaataattaaacaggccgggcgtgctggctcacgcctgtaatcctagcactttgtgaggccaaggtaggcatattgcctgagctcaggagttcgagactagcctgggcaacatggtgaaaccccgtctcactaaaatacaaaatattaaccgggcgtggtggcgcacgctgtagtcccagctactcgggaggctgaggcaggagaatg[132 bp omitted]acccccaaaactctgtctgttaaatggtgtgtttttcatagggatagcaaattgaaattactactcaatgaattttgctaagaaagactttttaataagaacagttaaaaagtcatggttaaattcacttacttgtaaatttcctacacctctccccccagggttgtatattaaaaatcccttctaggaatgtacagaagtggaaacttccacactctacttttattaaggatttcgatggaacaattactgttgcctcatcactgatttaaaagcaacattaagttccttgtttgtagccggtctcaggcccacacacctcccattggccacctcctgtgcatagctattggtctgtcagtggctccgtggtgaagtagagcctatcaatgcccagggtatcccaaggcccgccttctactgcactgctattggcagatctcgctgcctgttggggggggcctgttgcggagagaggctccctgggttggcagagaggagctggtggttgaggggcctgagtcaaacctgtgttcccggtctcagagaaatgtgcatgcacggtcaactcccccgaaatgaacagctgagaggacggcggtgggagggggtcccagagatggcgctctccaggccgcagcaggggccggtgaggtcggcggctttggaaaatgagagtcgcacgttttagaggaggtccccaggcacgcaggactgctgggtggatctgggattccttaaggaggtgcccatggcccgcacccttgttaaacactttttatcaaacgaagtcctggagcactctctccttttcccctctggttagggcagcctgaaccttaatgtcctcagctataaaagtagcattacaacggcagtcggtgaacacttcagattttaaaaaattttcagacatatttctgagactttaaaatgaacaacaataaaaaccaacaagtactttgataactttacatttttttccagatggataattacaagggggatgtcagaaaactataatcaactagtttgggttttaatttttgtcttaatacatggtacttctaatggtttaaatatggtggtgatgataatgacaaaaagtcaaaaaggccaggcgctgtgacatgcgtctgtggtcccagctttctgggaagatggcttgagcccaggaggtcgaggccgcagtgagctgtgattgcaccactgcactccagcctgggtgacagagcgagactctgtcgcaaaacaaaagaaaaccaaacctaaatcactttaaaggacttcatgctttaaagtgtcaggtacctgtaaggtacttggctgaagtgccagttgagatgggtgtgaagtgagtctatgagtccttgggggagaaagcattgcctttgagtgggctatgtcccctacccttcccctccttcccccatcctgcaaaagcaatgagcttttgctggcatttttctcatctttttgtaaacgttgaacgatggagccagaggtctgtcttcaaatactgcctagaaattaaagtttttaaacaaattaaatatttaagtgaattgaaatgtaaaatgcactcccctattcccctccccaaagcccctcactgagctccaaacaggagttgttcctgaccccactggcactgaggtgtttgccagggctcctgcagtgggagatggagattcagggtctagggatttaatttcagaaaaaagaattttttcaaaataatttctctaaccaataagaatttctaagaaacaaatgtttagaattatgtttgtggccttcttctttttttttttttttgccatgcagttcttattctggtatattacacataaagcaaaa[132 bp omitted]tgagactccatctacacagaaaattttaaaaattagctgagtgtggtggtgcatgcctgtaatcccagctacttgggaggccgaggtgggagaattacttaagcccaggaggtcaaggcgcagtgagccatgaccgtgccactgcactccagtctgggtgacagagccagactctgtctcaaaaataaaaaaagataataataaaaatagagttcaatgagttctgacaaatgcatacagaacattccaatcacctgcaaaagttctttaatgcacttctcagtcattctccctcaaaacaacatctaatgtgatttccttcactatagattagttttgcctggtttagatttcatatgggtggaatacagtatttctcttttgtgtctggcttttttcattttgccccatgtctacgagattcatctatgctcttcctatatgtcagtaatttattccctttcattgctgagtagtattccataatcccattgttgtatttttttgtcagttctgtttctggacacctgggctgtttccagttttttgctattaagaaaaagctaatctgaacatttgcatacaagtttttgtgcagacatattgtaatagtagcatgttgtagctggctcaccagagcggattttgtgcatctcttttaaatctggttcagcgactgtcatattggtagcctgaaataagccatggggacagtacaaattagagctgttttcttcctggagcgttggttgtcaaacatttaccagcacaccattggacatgtgttttcatttctctagagtaaatacctaggagtgagattgctggattgattgcatggcaggtctatgtttaattttatatgaaactgccaaactgtttctaaagtgcttgtgccactttacactcccaatagcaatgtatgaaagttccaattgctctacattatcatcaatacatagtattgtcagtctttttaattttatccattggagttgggcatggtggctcatgcctgtaatcctagagtgttgggagaacgaggccaggagctcgacaccagcctgggcaacatagtgagatcctgtctctaaaaaaaaaaaaaaaatttttttagccattaaatg[132 bp omitted]tgaaatcccgtctctactaaaaatataaaaattagccaggcatggtcgtgggcgcctgtagtcccagctactcaggaggctgaggcaggagaatcacttgaacccaggaggcggaggttgc[133 bp omitted]gggaggccagtaggcagaacttctgtcttccttcttatagacagagaaagccatgtgataaatacagattgaaatatgttgaggccccccctcacctatgaccttcctctgatctttcccattacattgccaaaggatgctaaatctccaaacaggagaatgcagtcacttgaaacacaacaggccattcatggtgttggggaaataattaaaaagagaatctcgtgccaacccaatgaatcctctccacaaagtagacaagaatgaaaagtttttttttgttttttgttttattgagacagggtcactctgtcacccaggctggagtgcaagtggcaagtggcgtgatctcagctcactgcaatctctgtctcctgggttcaagtgattctcctgcctcagcattctaggtagctgggattacaggcgcgcgccaccgcgcccagctgactttttttttttgcatttttagtaaagacggggttttgccatgttggccaggctggtctcgaactcctggcctcaagtgatccgcccgccttggcctcccaaagtgctgggattacaggcatcagtcaccgcacccggcaggaatggaaagttttataactgaataagcattacaccagactgtgatgcacatcacaaacaatctgctaaagaggtttcaaagacagaaagaaatctcatccgtttatgtagcaggcagatacagcccattacaaacatattctcaaacaataacttgtgctcaagaaacttgacggcaccatttggtacacatacttcatcccaaattcacctggtaattagggtggctatctgtgttagttaattgcctttatccaaaggaaaacgaaaactcatatctctatgacaagcaggtaataacttgaagccaggcacgcagatcaaattcccacgaagacagggaaagacaggggtgctattttcattgatgtttacatttcaaagagatggctacaaggctcttaagaaaaacattccggggatgtaaaactggcaagagatttagcttttaaaaggacttacatacatctcaaagggacagagaaaattttacagttacaagttttctaaaggaaatgctctaagagagacgtctttctcttttgacaccagggaaaattcgatctttaaaaatttgtgtttaccccacaatacctccacacattgactggcatcgtgctcccttccaggtccgcacttccctcttcacctggccacctgtgactagtttttcatagtcctaatcaaccccattcctaaaggaagcctcccagacagcaggccgcccctcctaggcccagtcccccagcccccgccacaccagagacccgctgtcctcaaaggctatgaactacagtctcctagagctggtgaacatcgccgatcattggttctgattccaacccatttcaaagatggtaaaaactgagacacgggaaaatcataaaagggtgcttagggcactggcccaaaaagggtacttaaggatttctccgcccagatgccaaagccctaaggtcagccccaaatgacctgtgttctgctttatacgtctatgccactgttggggttaaagccctaggcacgcaggtcttgcctcaactgcgcctgcgcgagtcaggacgagcgcttgccccagatcttgacgtttcaggcggcccctcctaatccggaacacgactcacattccgttggtcttgccttgacagacgtgaccctgacccaataagggtggaaggctgagtcccgcagagccaataacgagagtccgagaggcgacggaggcggactctgtgaggaaacaagaagagaggcccaagatggagacggcggcggctgtagcggcgtgacaggtgagggcgggcccgggagggctcggtttctggagcggctgccgggcacgggcagggagcccggaccgaaagctcagctccaggatggctgcgcttgggccccggcgttccctgcccggaaccggaggagtggtttgacccggggcgagaccatcgtcgacagcgggggtggggtgggtaacaggaataggcgggcaaggctgcgggtgatggtttcgcccgctgctagtggtggtgcgcctgcgcagagccggaagccctttggtaggcgggacccgaccgagtggtgccgggattccgtcttaacccccgctaaggtgtccaatgacctttccttaccaactgcggggagtgtgtggaaacgcggttcactccccggtttccttattctggatcagtgtctgaccgcccccgccgggagaatgtcaggattctcgcctctgtaaccgccttccatgatccctcattcagtttagaccagtaatatgcctgtgacccctcacaggttgtcaaggagaattttggagctccctctttacctccatttttctccccgcaacaccataccttccttctccttttgctatgacaatgtctggtggtccaccattacctccccagttcggctcaatgtctggtcatttccatttccacccttctccccattacagtccctagtgacgcctgttacatctcccttccgcatagtatgtagtgaccccccccccccatgaattcctcatcatagaggcttgggacttccattagccacctaacaacggtgtctgtggtcctaacatcaacattacaccccagggcttagggatgtccacagtgccctttaaggacatgtttggtgcaacctccatcttccccaaactaagggcagtatctgataatcctctctttcccatcaccgtgcctgcgactcctccctcaccacagtaactggcatttcccccgttctctgttaaaaaaccaggacactttgggaggctg[135 bp omitted]gaggcgggagaatggcttcaacttgggaggtggaggttgcagtgagctgagaccatgccattgcactccagcctgggcaacaagagcgaaactctgtcagaaaaaaaaaaaaacagaaaaaaaaaaaaaaaaaacccaggacattctgttcgtgcttcttatgtacctgacggctcagtgcagtgtgtactgacttccccattggtccccagcacagagtcttgtgtgctcctctaccctccaagacagtatgctctgtcccccttccctgttctctcccccgcaaccctgtgcagtgaagctgagaccttggcactcaagagtgagacaagcaacaggagggcctgagcagagaaggaactggaaggacttcagatgtgagcaggatctcttggactgtcgtgtgaaaattaggctgcagggggcgacaggagcctggactttgaattttattttgtcccctgccactttgcttctagactatcattattggacctctgaattcttgtctgccttcttgtaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgagtcatggaagcgaaatggcaggggctgtggatggacccagttgtaactctgggatcaaaagggtgacaacggttgggggaggcctttgcagaaggatgggaacatcagctgcgcttctgttgggcattgaggacccctacatctgcacatacacacaggtgactgtccgggatggcatgagtgtctacgactctctagacaaggccctgaaggtgcggggtctaaatcaggactgctgtgtggtctaccgactcatcaaggggtgagtgtggcagccccacgcccacccactgggtgtcccacctcccatcccctcctcagtcatttgattccttctgtactttatcacagagtcttccattagtcttcccttagtctttagtccccccttatctgcagggtacatgttccaagacccccagtggatgcttgaaaccatagatagtaccgaacccaattgctatcagtcggaacatgtttctattcttgtcttctacccataaatgtaatgccttttccgtcttaactaagcacgtatcatgcactccggccatcacttttgcagtttgaggtatgacatcaaaactagcatgaatttatttttccttcttcacaattccaaagatggaagattctttcttacagtagatctcagcaacctcagcatatgattttcttttaagtcaagaacttttacctttttgcttaaaggaagcacattacagcttctctttggcatgtccgaattgccaccaacactactcttgtgcttttgggccattattaagtaaaatggcggtcacttgaagacagccactatgatattgagtcagttgtttgataactgagcaggctactaagtgatgggcggtagcgtagacagtgtggatctgctagataaagaggtgattcacatcctgggtgggatggtgcaggatttcatcacgctactcagaatgcacgtaatttaaaacttatgaattgtttatttctgcaattttcaatttaatactttcccacccggttgaccacaggtaactgaaaccatggagagtgaaaccacagataagggaggactactgtagttcaagtaatctatgagttcatccatcttttgttttgttacttcattggtttattggcctgtaaggtcagcaactcattctcccctggcccccaagtcctcaccctggtccatcacttctgcccagatttcatctattttgtcctttcacgatgtcatgacttcatcaggtctcttcttcctcattttccccattctctgtctgctgagttgggtcttgctgactttatttattcctctctcgtgggtttccttaatttatgatgcagttcacacactgcactttatttgttgtttcagtgcctcctcagcccccttttcaggggctggcttagcgcttctaagatgtagttgtttagtttcatttgcttctccccttccgtttcagagcatggactcttcacaccgtcatgcctctcattacccttgtggcccagggccagtcactttatccctctgagcctgtttccccatctgtaaagttggggcaaggatagtgactaatttctagagttgctgtgatgagaattaaacatgccagacatgaccctgtgggtagcaggcttggagggacttgtgggggttccctgcctccccatggcccctacccaacctcccactcattcctttccatgccccctgcagacgaaagacggtcactgcctgggacacagccattgctcccctggatggcgaggagctcattgtcgaggtccttgaagatgtcccgctgaccatgcacaattttgtgagtgcagggtggacggtgggggtggaccatggttgggggtgtccttgaccaggtctcaaacttccctgctctgtggcatcaggtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagtgagcccagcctggggtgggtggggggatggggagcacagaggcccagccacgaggcccttacagacagctgacccgtgtccccttgctttatacccttcatgccctcaaggttctaccacagtgtccaggatttgtccggaggctccagacagcatgaggctccctcgaaccgccccctgaatgagttgctaaccccccagggtcccaggtagggatgccttagctgaagagctgctgggggagaaaaagatcttggggctcttgtagaccacgagccatactttattcatttgtttacttgacaaacatttattgagcacctacaagtgtgagtaagggcatgaaactgggaccttgggcaagtcacctcatttctctgggcctcagttttctcatctgtaaagaggggatgatgatactttctaccatataaaggttctggtgaggcttaaatgagttaagacatgttcagtgcctagaacaggatctggtacagtgtaaataatcaatttttttgttattaattataaatatatttataagcatctaactactttgctaattctagtataatcatactcaagcctttccattttgaaatacgtattattttatcataaattacttcccttttattgcttttttatgttaaatattatataaaactatagctatattaaaatatattattgctctaatatatattttatgatgtgcatattttatggtatatttatgttattgtatcatgttgtattacataattttatataatgtagaacatcatacatgtttatatgatacataaaataaagttagggtattattttaaattatgagtgtatgtgcattaattacctttgagtttcatttcaggatagtgaagggaacattaacatatttttgtaactttacaatatgtttagcatatatcatatgtataacatgtatgtataacaatatggtaatatgtatattttaaaacattgccatttttatatagatgatacatattatataacatttgaaaagtacatgtaattataatatataattataaaatatgatacattaccctttccccactatctgtgtggcctgctatcctgcctttaggcgtttactccattgtcatctcctcctcagagaaacctttcctgacactttctaggaacactttgtgtctccttattttgctttactatttttctttattgcacctatcaccatcaggcatattatatatttgttttttatttcagccccaccagggcaagaactgttattttgttttacagttttatctccaccacctagaatggtatctggcacacagcaggcactcaataaatgtttcttgaagcaatgaataatagtactgccagtggacattcgctctgtgtgagccaaatgcatgtttatggctgggggtggggtggggggctttctcggttctctgattcctggcagtgatttcacagcctttcccctggcagcccccgcacccagcactgtgacccggagcacttccccttccctgccccagccaatgcccccctacagcgcatccgctccacgtccactcccaacgtccatatggtcagcaccacggcccccatggactccaacctcatccaggttggtgctgtgggggacaatgccggggaccacagggcagagggtagagccatccctgttggcctccatgccctctttttgactcctgtccctcttcttctagctcactggccagagtttcagcactgatggtgagtcccctgtgcctgcaccctgacccccgctgccccacttacctccactcacatcctctctgcaactgcagctgccggtagtagaggaggtagtgatggaaccccccgggggagccccagcccagccagcgtgtcctcggggaggaagtccccacattccaagtcaccagcagagcagcgcgagcggaagtccttggccgatgacaagaagaaagtggtatgctcgagggggatccttttggggccaccaaggctgagtgacgtgggatgagggatgtgggcaggcctcttagatgccacccatctggcccacagaagaacctggggtaccgggactcaggctattactgggaggtaccacccagtgaggtgcagctgctgaagaggatcgggacgggctcgtttggcaccgtgtttcgagggcggtggcatggcgatgtggccgtgaaggtgctcaaggtgtcccagcccacagctgagcaggcccaggctttcaagaatgagatgcaggtgctcaggtgaggtggcatgtgtgcgtggatgggggtggcaggcccggccttggcatctctctgggaaaaggccatgcttggagtgcttcctggacatcacctgtgtttgtgttgttaaaccatcatcagaagttgtttctctctgaagggtgtccctttcccctctgggaaatgagtatgtttagaggacctgtgatcatgcagttgtttgtgtttgggttattaatgaatggttctgcctccaaaatgtgggtcttctcatttgcctgctgcgaactgggtctgtgtgtgggccaccattcttgttactgcattgccaggaaggcttccatctttccttcccctctgcttgggctacaatggtaatgttctgtttatagtgttggttcttgttattcattaattctaataccttgatttaaacaatattatcatcatcaccataatctaatcattgcttaattattataattgctgtaatatgtaatcaatacagtattcatctagtcacgctaagaaagccaggtgtctcctttttgctgctatagttactatgtagcatagtactgtatacctatatactacaggtagtactggatagcgtctaccaaccctggggatgttggcattggcttttcctctgtgtcagatgggcacaattatgttacagagaataaggtagctaatgcaatgatcagttttacagttgaggaacatgaggcccagagaggttaaatgtctttcccaaggttgtaccttgagtacctggtgaggcctagatttgaacatgagtccagactccaagctctttacctctaagcttctcatgctgctgaacaggctctaatcatcatatatcaccaatgttttaatcctgcatctatccatattatattgatacatcagtgaggaaggttggcattctgctttctcatctgtgagatggtcacagacccaggtaatggtcagagtcagaggggtgggggatgttaatgattagaaatgctgctgtaggcagggagggggaggggcagcaattcctccctcctgcttttgttgggagactcggatggggaagctccacatatgagcccacagcacagaatcatagcccagtaaacacatctcacaaattcatggaatctggcaatgctttggtcctgagtgccccaaaagacagggtgaaaataaatgaccgaggaaggtaaagaacagtgccactcctgatgctcggtaagtgacagttgctatttttcctccccacctctgacactgccctccctgcctgcaggaagacgcgacatgtcaacatcttgctgtttatgggcttcatgacccggccgggatttgccatcatcacacagtggtgtgagggctccagcctctaccatcacctgcatgtggccgacacacgcttcgacatggtccagctcatcgacgtggcccggcagactgcccagggcatggagtgagcctcccagcctggggaggggtggggggaaagggtgggggaaatgaggtaacccccagccaatccgccacctgcctccacccccacagctacctccatgccaagaacatcatccaccgagatctcaagtctaacagtatctatctgtccctgggctggggttgagtgggggtgtcaagggcttagaaggatgcctcttgtgggggttctgggaattacaagggaggggcatgtgtcccagagctccttgccaggtggcagagctgtggccagccagggggctttaatggcagtctcttagaagtcagaggtgtggctggttcaggtactattcttggggactctggttagagtctgatgtctgacagttgtggagggcattatggtcaacatcagaggcatagtgggttcggatgccctccgaggggcttcctgttcaggagtcacagcggggctgagtgtggggggcattagcaggcgttccctgcccacgtcaaggttgtggatagtttgcgtgatattaaggggctcctggtcaggatcagagggatgagtggtataggggcaccaatgggaacctcccaggcagggtgagaggcatggctattaggagtccctgtagtggtccttgaccctggcggacatcttcctacatgaggggctcacggtgaagatcggtgactttggcttggccacagtgaagactcgatggagcggggcccagcccttggagcagccctcaggatctgtgctgtggatggtgagttgggccaggctggatggggggcacatggggacgtgggctccgggattggggtgtgtggggccaagtggggacggggatgcctgtgccagatgtgggtgtctggactcctcatgtcccacctcgtgtgggtggctctgagttgtaccctgtgtggccagtgggatctgggactgtggaccagccatttgctgacctccgtggtccccctgcctggtctggcctgttgtaggcagctgaggtgatccgtatgcaggacccgaacccctacagcttccagtcagacgtctatgcctacggggttgtgctctacgagcttatgactggctcactgccttacagccacattggctgccgtgaccaggtgagccccacaccttacccacagttccctgggctgagggatcccctcaggcatccataccccacatcccctcctttgcactgataaatgccacactttccccagaaacctaaaattttctaggataaggactcccagaatcccttgggctccagacacttacaataaattctctgggtctcccctaccccaacttccctcttctcacatccacagccctctgggacaaaaatctttgaagtccaaaatgccccgaatctctatacctagaatcccctgaggcccccaaataccccaaagccctctgtatccctagacgcctatagtcgtctgctctgggtactcaaaatcccccagatcctcaaagcccagatctcatttctcccagcatcccatttttccccagaaacagaacccctttgtgcttctggaatagtcatggacacccacagtcacctaggccttgggtatctagcaggccccagggccgggatacctagaaccctctaggccccagacccccacagaagtacaagctcccccagacccagaactccatgttttcccgagactcagtactttccaggtccctaagcctcctagaaacccgtgggcctataatcctctgagccccagatacctacaatccttgacaaccccaaatttaaatccctctgttctgaaagcagagaatcctcccaagtcctcaaggacagagaatcctctgggccttgatactgacagtaccccagctcgctaaaaatgaaccttccaagtccctcaatacaaaattccttgggcctcccagcccctgaccccagatcacccctttcctgcccccgtctgcccccagattatctttatggtgggccgtggctatctgtccccggacctcagcaaaatctccagcaactgccccaaggccatgcggcgcctgctgtctgactgcctcaagttccagcgggaggagcggcccctcttcccccaggtgggctgggtagggggctggacaccttgggtgggtgactctgggatagaggaagactgagatggaggcagatgtgaatatgaaagctcagaggtatagtgtgtgtgtgtgtgtgtgtgtgtgtgtgtgtttcaccatgaggctgggactgttgggggtgtgtgtgtatgtgtgtttcgccatgaggctgggactgttgggtgtgtgtgtgtgtgtgtgtgtgtgtgtgtgtgtgtttcgccatgaggctggggctgttgggatgcccacagggctctggacacccctcctcacccccacctgccctcagatcctggccacaattgagctgctgcaacggtcactccccaagattgagcggagtgcctcggaaccctccttgcaccgcacccaggccgatgagttgcctgcctgcctactcagcgcagcccgccttgtgccttaggccccgcccaagccaccagggagccaatctcagccctccacgccaaggagccttgcccaccagccaatcaatgttcgtctctgccctgatgctgcctcaggatcccccattccccaccctgggagatgagggggtccccatgtgcttttccagttcttctggaattgggggacccccgccaaagactgagccccctgtctcctccatcatttggtttcctcttggctttggggatacttctaaattttgggagctcctccatctccaatggctgggatttgtggcagggattccactcagaacctctctggaatttgtgcctgatgtgccttccactggattttggggttcccagcaccccatgtggattttggggggtcccttttgtgtctcccccgccattcaaggactcctctctttcttcaccaagaagcacagaattctgctgggcctttgcttgtttattttgtttcccgactcttctcttggggttcagagccgctgaggggtggggtgagtccaggcaaggagtgaaggtcagggggaggtgcggaccacataaacagcgtcactgcacgcatcaccacaggcggcacgatgaacgaggaccacatatgccaagcacggcacaaaaggaggccacgtcagtcacagacacagacaccacagcaaaggtggggaagcggagaccactggccttccgtgtgcaaaggattctgggaagatgggtggagtttgcatatttaaagacagctgtcagaggcaggaaactggggagggggtccctgggggaaccgaggggtcctggaagtgggaggggctcccaaggtattgaatgaggttgaggggagctggtgaagggaaatccttgtggggctaggtgttgggtggcatttgaagatgtggatcttcagagggatggaagatccatgggaaggggctcaacagtaggggtttcttgaggatttggaaaattatgatgggaaataggtgtgctggagagatttgggaccaaaaatagggttttccaggaacttcagggctccaggaagggattctgcaatgggttgcctggtatttgggcacttccaggaaggaaaacgccctctggggaaaccaggggcggaggtcttcaggaatgtggaggttctaaaacagaagtagatcctgaagtgaccacgagtggggttctaaaaggacttggggattccacatgtgagaaccggatttagggccaggaggagtcaggtttctcaaggtactcggggatcttgaggaatgagaggtggaatcttggagaaccgggagatgggttctcaagggatttggagactccaaaagtgagaaatggattcagggcccagagaagggttgcccagggattttggggttctcagagtggggtatcagtcggagaagaggctggcgaaagacttcctcaggctgcggatggtctcagctttcacctcgtcctggctaaggctgggcctgggcggggctggctctggaaggttgaaggcattggtcagagactgggatttgctagagagagacaaggtggaggcgtgggaggaagggggaagaggaaggggaggaaggggagagaaacacaacgttaccccaggcccagccccagccctgcccctctgatcctggggctgtgcctgtgacctccccacctgccaccatgggcctggaccctaacaggttctcaaggctgggagcactcaggtggagtgggtggagtcctgggccagggaggcgagatctgggacaggctgggaggacttggatccagggtgaagtgtgggattcgtggcaagagtcctgggcagaaccttctctgtgaattcttggctagtttgatacaaaggggaagatgagcagggaagtttccaatctaagggtgaggtgtctaggagggcatagaaagggcttggaccaaggacaggctgttgggcaagtcagcctaaggcagagcagctgggtggggcagggaggacgtctgagctgggatgggagttggaatggaccagaaaaggcagatgggtgatgattcgcggggagactgagatgggccagaaggatgtgaaggaggaggaaaagtatgaggatggagtgggaagagccagatgataggaggactaggactcgggccaggagttttagggatgggttggtggcgggggggcgagtttggcagggaaggctctgggctgggcaggaagttgcagagggtgggtcagccaggtgcctgggaggccctggaggaggaaactttcccagggcctttgaggaggaattcgaactgagtgcagtttctctgggattctggcaccaaattcctggggtgggggtgcggagcctctggtgggccgggaggagcgaaagcttgggggaagggcttggctcaggctggagagagttcgtgggacccctgcataggacctgggtctgaggagcaagggagctagggctgctctactggggcagcggcccgctttgtgagcagcaaggcgaaggctgctgtaggggtccccttacttgagctgggggtgcggaggtccccctgcagcggcggtggcgggtggcggcacgtcctggctgggtttctgggccagctgtggtttgggacgtccagcggggcccgggccgctgggccgaggctgctgcgtggtgggtggcccagtgcggggcacgggacccgcctggctggcctggcgtgtggggccggctgggcctgggggtttctggggcgggccctggcgctgctgcccgcccggtggggccccagaggcctttggcggagccgggccagagacggatgtctgacgggtagcctgtggggggcccgcctggcgctggggagacggagaggcgggcgggcgggctgctggaggcgccccggggcctcccgccactggccgggattggcggccttgaccctgggtcggcggcgcggcctgggacgcgggctgctggggcgctgaggtgggacttggaaggcgctggggcagggggctgccagctgggggtccaaggcctgaaaggtgctgctggccctgcgggggcgggcgctgctgcaatgggggtccctggcgctgggggcctggacccggctgtggagggccgcctgggggacagagggagagaaagagcacacgtgagagtgagcgggtaagagatggcgggctgagggaggggactgcgaccgccagcctctcgcttaccctgtggtgggggtcgctgctgagccgggggccctgcgggctgctgggaggtctggcggcccaagggcagggcccctggggacggagtctgcggcagaggaatggagcaggagaggttaaaaatagttaccagccagtggagcatcagccagtgatgacacaggttccctgtgcgctgggtgttgccccacttgtggctgagctgagggtactctgggttgtggggtgggggacctgttcccaggggcggggcagggaggtgctcagggaagtcagggcagcagctgcttatcaatgttttaaacaattggcaatcgcagccacatgtgtgcaaaggtgatgctgtgagcctacagattatcagcttcatggcacagcatgacccagggccggcctccccacactagctcaagccactagctcagcgccaggggcctgacctggccatgggagcccctgccaggggaggcatcccgctgtcgctgccggggcagggcctgagccatcttgttgaccacgagctctacgatgagctgtttgtcttcatcctggtggtcaccaatgagcggcatggaggaacccaccacctgggggaaggaaaggatccgtgaggggagaggcaggcctcgcacctgaggcggcagtaacaccgtgctttcagttggccaagggcatggccgccgctgagccccagtgtctgaggcactgattgtgcacggtgaggaaggcttgtctgttccaaggtaccttacagcttagaaggtgcttcagagcagggctcagcaaattagggcccatgggcccaacctggccgaccacctggttctgtatgacccagagctaaggatgggtctttaaattttgtaacagttgaaaaaaatcgaaagattttataacatgcgaaaatggcatgaaatttaaatttcaatgtccataaacaaagttttattggaacacagccacacttatttttttaacatatcgtctatggctgcttttgcagagttgagtagttacggcagaggctacgtggcctacaaagcctaaaatatgtaccgtctgctcctttacagaaaatgtttgccgatccctgcttcacggttttctaggtgctttgtcctttccaaaatgctttgctgtcggtccagttcgcagaatactttaaaggttactaagtgcctcgccattcaccaagatgtctcgattcgcagagcactaaacaatctaataagggttttgctagtcaccagggacgtgcaagttcagtctagtgttctgccattgcaagggatggccccttcgaaagttcgtcaggcaccttacagtgtactaagcacattgctgttggctgaggacctctgtgccatggagtgcttcagtttgcactgctgctgcctggcatctgttcctccctctaccccacctacccctgggtgctcatacctcaatgatgtgatcccttccgtccttgccatgtagcgcttccactgcgcagatgtccagtcccccaaaaatctctgagcacgtgtccacccacagcttgtatctgccaagacaaagggtggggaagcctgtcagtctctcacctgagctgtcgtgctcccacccccgcttcccctcacaccctgagttcgggctgcccacctgtcagacatggcaatttgctccagcatcgcagagccagtattggtcttccagttccctgacactgacgtcctcctgggggacaaggggacagaagctcaggggtgcctcagctgcatgaggcaaggcaggggaccccttccagggctttggtctctccactcacatgtaggccttgtagttctgcccaatcttctggacacgcacgtcatatttggcatcgatgaagggctcggcagtggcatacgtcttggtcagtgccacgacacttgcgatgtcctggaagtcatgctggttgtcaaccttgacctgtggaagtgcgggcaaggatcagggcctggtcaggatagggcagctgtggggagtgggggtgcctgggggagcatgtatacatgacacacaggtgaggcgagtacacaaaaattaggtggacatgccaaggcgctcaagcaggcacgatcatgggtctcctgttttgtatgtgagcacacaggcacaaagttgggtgtgtagaacactgagcataccaaaatgtattggattgtctactttaaatgggtgagttgtagggtgtgtgaactatctctcactaaagctgtgaaaaaactgtgtatgtacaatatactaatataggcatccagacacaaaatcaattgtacacacaacatgctaagatacagaaactcggacacaaattacaagtctactttctacgtacacagagacaaaatcagatggatgtaaagcacacaggaccccaagactttggaacataaaagatcacaccacatcatgtgtgttcggcacaggcatgcatgtacacacagacacgatgctggagacaagcaaaataacaggacacacaaaattggctgaatgcaggaggaaaaaggggtcgatgaggtcagctgaatgtgagaaaacaaaaatctattaggttggtgcaaaagtaattgtggtttttaccataagaactggcaaaacccgcaattacttttgcaccaacctgatagataacgacaccccaggagacgcgatcacacagaatgactggtgtgcattgcacaaatacacatctacctatgcacagcccagccagagactcaccttgcccatcccagagtgtgcgtgccccatcttcacaaccacggggtacgttgtactgctgagctggtggggaaaaggcagaggagacatgctcagggcagaaagggtgacctccaggggtggggcggcactgaggggatcccagccagtgggaactgcattatgagtcacttcccaggacacacaggtcagagacaggcaggcagcagctgggggtcacacagtgtctccacctccgggcccagaattgaacccagagccctgtctgtctgtccctcactccaccccaccaacaagttccagacgtcccgcccctgctttcccgggcagaggcatggtatgagcgtgggggactgttccagtaaaaagaaagtttgtttttacagtggatggatgatagtgaggcaagtgtgtgccagtgcgtgtgtgtgggggtggggggggtggggagtggtggtgagcatgtagtgactgaacccctcagccaaaccttgtatgtaagcctcacctgcacacataaactattgagaggcatgagcccttggaactcagatgtacatcgccaaacccagagatgccagtgacattgagactgacagccaacacaggctcaaagcacatgagctctggagcagcacagacacccacacagtcattcagccagccaggtgcccatagcgtgggtcagcagccagcactccagggcagcacacactggacacccttaggcacacaatcaatacttgggcacacacccaggttccctcccctcacccaaacccacatcaccatcaggggaacacacacaacacaaaagattacccgtccaatcaagagacacacaactccacaggcacactccacagaaccgggcacatactcaacacacaggcacacataaaacacccctaggcaaatgcacagcaaataaggccctacacaacacacagaggtgtatgcacttctaggtattcacatcaccactgggacccgtaagagacccacgccacattcctgggcatacaaaaagtatatctagacacacacacaacatgccttgccacatatacaatacagagaggctacacacaaccagagacacccacaactcagtttgcagaaaacattcctgggcactcccaccccaacacacatacagtcacacattcaggcgagagggatacctcaagtctcccccgctcctggatggggtagaggaaaccaggttggacggccctaggctccccgctccctccacccccacccccacagcacagctgcacagtgcccctctggtggccctccctctcgctgacaaggtagagagatggcattcccggaggggctgctggggcggtggtggttcccagttcccgacaggcacaggaagcccgcagactcagggtgaccgattgaccttaaggcctccctctgcacacccccccttcctcatttcccaaatgactggcgtcattatgaggtgggctgagaggcacgatgttgggacgggggtttggggcatctctgggcagcgggccagggaaacgatgccgaggcggatgcatacagtaccacccaggtgtgcgcacagcacacagaagtgcataatgcactcagttacatatgcaacccagatccgctttgccgaggctggtagacaactcccagaagtaacacacaaaacacacaggcacatgctcgactcttagcaatggacacacaacacaccagagagctgtgcgtacacacccatacctcccccaacaaccctgaggtttctaggtgcctcttttcgttaactgtccttgttttctctggacttgagcctgaacacaacgctctgtatatgtgtgtgtgcccatacatgtgtgcatgcagagtgctttgaactctgactctgggagctcctggaaagccctaggtctgaattttggcctttcttcttcctaaggccatgaaggacacaacctctccctgagcctcagtttccccatctgcacaaagagcacaatgaggcccaagcacctggtatgctgtgggcattgtcaggtgtccgctttgcacatgcctcctggacccccatgggcccccacacccatccagctccccagatggtcacacacccctccatgaacacccctcccactctccatttcaaaactgcacaataaccggatccacacgactcctcatgtaaacagtcggcaacactctgtgctgactcaggtttcaaagagttggcgtcagaaccagagtcagcgaggggccaaggcaggacttcccctgccctcacttctccctcggaggcaccaggttactcagccccgtctcattcactctcactgtcccactttcataatcagctcctacagatttttttggtttacttcccttcctccctgtttttgtcgcccccccaccctccccccaccaccccgcagcagagccatttcttcattctcattcctgggtaggtcactcagcccttttgtgtctaagtttcctcatctgtataatgagaacatgagctatatctaactcacagggatattgtgagaaataagttagttattttgggaaaaatgctctacatggtatcgggcatacagtaagcctcgatcctcaagaagtgttgggtactcttattattggcttaacatctcttccttaactaacattaatgaacaaagaggcaatcgggattgattaaatgagataatgtctgtaaaaagactttagaacagtgcttttttttttttttttaaatagagacagggtttcaccatgttgcccagactggtcttgaactcctgagctcaagcgatctgcctgcctcagcctcccaaagtgctgggattacaggtgtgagccaccatgcccggccaagtgctttcttaaaaaatagatttaggctgggtgccgtagctcacgcatgtaatcgcagcactttgggaggctg[134 bp omitted]gaggcaggagaattgcttgaacccaggaggtggaggttgcagtgagccaagatcttgccattgcactccagcctgggaaacaagatcgaaactctgtctaaaaaaaaaaaaaagatttagaaggccgggtgtggtggctcacgcctgtaatcccaacactttgggaggtcgaggcaggtggatcacctgaagtcaggagttcgagatctgaccaatatggtgaaacccccgtctctactaaaactacaaaaattagctgggggtggtggtggtgtggctgtaatcccagctactcaggaggctgagacaggagaatctcttgaaccccggaggcggaggttgcagtgagctgagatcgcgccactgcactccagcctaggtgacagagcaagactcttgtcaaaaaaaaaaaatagatttagagggtacagctgcagttttgtgacatggatatattacatagtggtgaagtctgggcttttagtgtccccatcaaccaaatagtgtacattgtacccattaggcaatttctcatccctcacattcctcccacccagaatagtgctggatacgcagtaagcactccataagggctgctggtagtttttgttgtgttcttgttattgggctatcatccctgagttaatcaaacttaattagcaagggagtatggtgagtgaatgagataatttatacaaacactttagcacatagtacacagaaagtgctcaataagtggctgccatcatcactacaattattattattgatctatcctcctcgaattaaggatgttaatcagaaccccagggaaggttcctgcattgtcagaaagctggtgggcaaggattgccccaccccaccccccaccaggggtacaggtccatggggagggggcagggcaggatggggtggggattagttttctactgacccactcacttgcttctttcaccatcattcatggccacccccttcccaatgctcattcattcacccgcaccattccctgcttgctaggacggtgccactcctgagttacaaccctggtgccaggtagcctctgtttgaatcccggccatgccctgtgatcttaggaaaattctacagttcctctacgccccatatttcctcatccgtaaaacgggaataagaaccggtacccatctcagagatttgttgtgagctttgagtgagataaactatgctgagtgcctggtatacagtaggtgctgtataaatgccggctatttgcctgtgttatttgagaccctggctttggctcctggccacctgagttccagtctcagttctgccatgtattgactctgtgatcctgggtaagtcacttaaccactccgtgcctcagtttccccattttgtattcctcccctttcacctgccttatctccctccactgctgctacttaatttgtttcctctctgccacccctcaccagcatgtcagacatacaaaacaagggatttttgtgtgcttggcacacagtagatgcacaataaatgttgaagggctgaactaatttgggtttgagtcatagggagcttgggggatgtgggtgattggatagattctggagactttaggggactgggccgggggaaatgcggcctctaagctctccgctgaggcggcttggaaggaatagtgactgacgtggaggtgggggaggtggctggcccgggcgaggcccagggagagggagaggaggcgggtgggagaggaggagggtgtatctcctttcgtcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagaggtaagcagggcccggggtggcccagcagggaccggagctgggctgcagcttgggtgctggccaccaggcccgtgcactcccgtgccagatgcctgtctactcagcttggcctgcgggtaccaggaccctgggctagtctagggggaagagggtcggaggctggaactgctttcccaaccccgaggctccaaactccctagaacccctgacatccgcccccaattcccccaaacccatgaccccctaatatcacaaatgctttccaaatccccccgcaaattccttcatcccgaaatttccctcatcgccccctaaatacccaccgctaacccctgcagctccctaaactcccccagctccccaatccccagttccccagctcccaaacttcttttgccctcaaattcctcaagtatccccattgccttaagcccccaaattcccccaaccccttcaacctccaaactcccccagctccctaaacccccaacctcctccaaattcctcaacctccctaaattcccccagcctcttatatctcttaatatacacaacccctaaactctgccgtctccaaactcctccagcccccaatcccaaattcctcacccccaaactcctcaacctccagaattccccaatcccctcattcctcaaacttcctcagcccccttctcccccaagtgccacaaccccataaccccgcaactcactcagtccctcaataatttaaactctcccaactctctaaaccctaaattcctctgcgctccccaatccccttaaaatccctaagcttaccaacccctcaagcccaaatccagccccctaatcccccccataggctgccccggggcaagatggggtggatgacctgcccaggtcagcagatcagctgggccggggcctgcctgacatcccccttccccacagaacccaccatggccccctttgagcccctggcttctggcatcctgttgttgctgtggctgatagcccccagcagggcctgcacctgtgtcccaccccacccacagacggccttctgcaattccgacctcggtgagtcctcaccccactcagcccacacactctgccttggtttccctttcagtccagtggggctcaccatggcacttacctctagaatgattccactcgcccctgcacttcctctgctttagccacactggcatcctcacacttccttgagtactctgtgcccaagcccaccacaggatctgcatgctggctgctccctctgcctggtacactttccccccaggtatccacatgggtggctgcctcaaacgtcaccttctcaggatggccttccctggccatcctgtttaaaattttaacccctgccccttagtactcctgatctcctgttaaacagaaaaatattcagtgatacttgttataacacagtaaggaagaccatattcaggaccatggtgatgggtataggaaccactgcaatgggatcttgcagtcggtgggagagattgggctcaacactgaatatagcatgggccagtgggaatgtgtagctaaggagcagtgtgagggtctgtgggtggaaattactaagaagaaacatcaggggtaagggggattctggctaaaccgacgtaacaggattcttgctgaaggcaggccaaggggaatcagacatcacctgggggatggtggaagatgaagaacccagtcagatagcaaggatgatcaggtattgaggatgatcagagattgaggatgatcagagattgaggatgatcaggtattgaggatgatcagagattgaggatgatcaggtattgaggatgatcagagattgaggatgatcaggtattgaggatgatcagagattgaggatgatcagatatagaatataggggttcttgctaaactgacttagcaaggctctcggctaaaactggattttacaaggaagtgcacagatgggcctaggaggaggttcaggagcctgagtaaagtttggtcaagcaaagaatctttgtcagccccttacccaggtctgtaattccccattatacttaatgtctaacattccatatccttattttgtttgttcttagcctgtctcctcctggctagaatgtgaactccacaaggaaagggatttctgtgttttgttcactgttgtgtccctaacacccagaacaatgtctggcacacagtgggcactcccaaatatttgaggagtaaatgaacaaatcaatgtatgaaaatggcttaagcagtgcccggcaaagagagacactcaacatacagatgaatcaatgaacaaatgtgtaaatcactttgtgtgctgtctggcatccaataacccctatttatgtatgcgctttgctggtatgatgatgatgatgatgatgatcttatttttattggctcatgcagtccatttgactcatatttccctcctctcctgcagtcatcagggccaagttcgtggggacaccagaagtcaaccagaccaccttataccagcgttatgagatcaagatgaccaaggtatcccctgcccccgcctctttcccagcattttctaacatcttcctcctggtcaaaacagaaacttctggccactggttggtgcgagaaagttggctgtgatcttgggatgctatatgacttcagggaagaacctggagtgggaggattatgtcagtaaaagagacacttcccctcatccatcaacagatgtataaagggttccaagccttaggggatgccgctgacatccggttcgtctacacccccgccatggagagtgtctgcggatacttccacaggtcccacaaccgcagcgaggagtttctcattgctggtgaggcaccgtccccgcgccctgtgccacaccaaccagtccctggggcgcggcctagcaaccacgagggggcgaggctctgatgggaatggtcccactggaaatggggaccaccccaatttcagtctatcagaaggccgggcctttggcagcttggcagctcagccaatcacaagctgcttgtcggtccccgccccgcctttctccttaggaaaactgcaggatggactcttgcacatcactacctgcagttttgtggctccctggaacagcctgagcttagctcagcgccggggcttcaccaagacctacactgttggctgtgaggaatgcacagtgagtgcctggaccctgacctccaacgggagatccttcccggggccattccctaaatcgtgggcttgtttcttgctccctctggctattctgtgtccctgtggctgctccccaaccctaagggctgtccctgatctctcttgctatttccccaagcccgagactgctcccttacaaattctggctgctccctttccctgtgtccaataccgtgtgatcacctgtccctccctggtccctctaattctcccttgtgactattctgtaatcccactccccgttcctgagcccccgggattgtttcttggttccccagaatgttctccaagaacccaaagtgctgttccctaatcccactgacccttcctcagcacatctgcttgttgctctgcagctctgactattccagacaccagagggtgttacactgacctcctggctagtccaagcctgttccctgatggctcctgatggcctctgagcccagtgactatcttgaagccccactggctattcctgtgcttaaactccttagccgccaaccgggtggggccccttactactgccagtttttccctgtcctttgggacaattccacaggcgacctgcctgactgacccccagggcctattccccagccaccattccaggacactgatttactggcttactgttacctttcaggacccagtgacatttccctcaatgggaggggctgtcctggggtatgtacttaggtggggtgagagcaagtctccccagcggctcagtgttgaaagctgaggagaggaagttctgctccacgggggaggcagggagaagccctcagagatgtttccctcctcccttccaggtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagcagacactgtttctgtgtagtgcctgggaacaaacccatgttgctgatgacctggtgtgagcaccctgggaccagtggggatgagggatgccaaatgttgggtttttatattttacttaaattctgatgtactggtagtaattctcaacattggcattagcactgatgatctgcaacagcagcaatggtcactgaacctgcattatcaaccgtaacctctgaataatttctccagccaatactttaaaacattttcctatactgattcctaattgctatttgcccagggctttctagttataaattatcccacagctgacaaatcactgccttactggaaattccccattcacacatcttgccagctgacagagtcattgacaaatgccctaccaattggcaaatgactatcattgcctcaagcacagtcctgatgttgtccagtgaggatgccccatccaaacacgtgggtgttactgtcctcatcctcaggttttgtaccatgagtctgacttgagtgaaaggggacccagggcacccagagtcccacagtaacccagctggggacttgggaagaaggggtggccctggctccccagccatggctgcaggacattccttggaagggactgtttggggcagaggagaggtgggatggagagaaggtatgagctaaaaatccccaagctctgccatcctccctcccctacttctcccctcactcctctgaccaacttggaaggaaatactgacagcaatgaaatgcaggtagggttcaaaattaagaccagccagatatgctggcccataccctccacacacctccctcaacccaactgtcccctcacccaaactagggtctctagactcgaccctcacctttatgaatcatcctttctctagaaaaactgagtgagagaacctccaaatactcccctctgaggccttcctgcttccacagcggggtccagtccctggctcctgcccctcatactccaaaggtcttgactcaagtgaggcccttgggaactagaatttcagactggtgcaaacattcaatggagcacctgtgtcctcctgacctgaacgtgcttgaaaagggccccaatatatctcctttggtaaagaaaaggacccccaaattccctctcatcagagtacccactgctcttaccagtaagaacccaggtctcctccagggcattctaggtcaccaagcacagccccctggatcttctgtggtcctgtcccagagccttttacactcctgggaggttaccccacggcccaaattatgtcccggatgggaatgggcagattttgaacacacagtactcagccacttaagcagggaatgcgcatgcagcaacaatttctacatcaacatctacaccttggttacgccctcggagggtctgaaccttgtccaccgaaggggccaaccgcagcctttgctgatgggcacaactgtaaggtaagggcccgagccctggttcatccctggtgaccttgtcaatgttccctcagctgcctgcaagaggctgaccgctcctggcaattcgccaaaccttagtgtcagctacctgcactcttaagctgctccctggcctcagggcccatttcctaagtcctcagctcttccaagccctagggggaaggtgaagtagcaggggaaggatggaacccagcgtggaggtcgttctcctgccgacctgtctaccctgcaggtcagcccttcgccaagtgcaatgcagaatggacagggaggaccggagaccagaacaggtctcaggggacacagagcccagaacagcagacgaggctacctccaccagagacctggcatgagctcctggcaggatctgtaaccctgggctcattacatcccccattgctcttgtagaacatctgttaaaataggtcaagtgagcatcctccatccccagcattcggggtgtctgtgggtgaatctctgggagagactctgtgacagctgagaggaagcttgtaggggtcacagccatgtggtattcagcatgggacccagctcagtggggagcctggggggccagtccttctctcacctgagcctcagtccttctcgccatgtttaaacatggacgtcacagtcctggcccagaatccttcagaggtctgtggtggggttggaggatgtttacggggtgtctttgccccttggatatttttgggggggtcaaaacacaggaaatgggacagtcatggtggctgacgcctgtaatactagcactttgggaggccaaggtgggcagatcacgaggtcaggagttcaagacgagcctggccaacatggtttccatctctactaaatatacaaaatttagccagctgtggtggcgcatgccctgtggtcccagttacttgggaggctgaggcacaagaatcgtttgaacccaggaggcggaagttgcagggagctgagatcatgccactgcaccccaggctgggggatagagcaagactgtctcaaaaaaaaaaaaaaaaaggccgggc[137 bp omitted]ccgagtatggtggtgggcgcctgtagtcccagctactcgagaggcaggagaatggcatgaacctgggaggcggagcttgcagtgagctgagatcaagccactgcactccagcctgggcaacagagccagactccgtctcaaaaaaaaaaaaaaaaaaaaagcaggaaccctggagccagatcatctgcattcaaatcttgcccctgccatgtcttagctctgtgtccttgaataaatcatattgcctctttgagcctcagttcctgcatctgtaagacagggataaaaagaaggcctaactcatagagacaatgtccatattaaatgaggttgtatatgtgaagtacttggaacagtgctaggcatatagcacttacaagcattagttactagaagtagttatgataactataacttataactttagtagtgattatttataatattgcaaacaatgtttgatattaggcatgataatatacgatattggaaataatgtgtatgattagtaccaataatttaatgtccatttctcccccacaccagtctcctcaccaaaatacaagctcctgaccctgctctgcctgaaggaatggggtaggtctccgagacccaaaagctcctgatgtgatactaagatcccagctctttacgccataaatgttcctcagtcccagtgtccctctctcttttccccctcacagacaatccagtttcctagtggagtcctgaacctgtggctcacagaagcacctgaaaataaagagcaatgtggttagatccttctacacgcccacccacaacaactgtggcgacaccatgaggagaggttcccctttagggattcctaacggcaggccagccaacctgtccccaccctgtgtggactcctcaccctcaggtctccctctgcaccaccctggaacaaaaagtccccatccctggagcattctccccacgaagaacccccgcctcacaatactatgttcccaacttcagcccgtcacagcaaattctgtccccagtccgtagtgttctgagtctttgagacttggggatcatagcatgtcctagccaagggacatatggtcatgctacactggtccttgggacatggcctctgtccctccaggtcctttgagggatagaagtctgcactctgcgagatggggggtgcatccttggaaggggctcagggaggagcccagaaagggcttcctgactttctataggaaaggatgcgatggggccttgagtgagtccctcagggactcccgcagccacaggcgtcccctttgtgttgtggctcacccctgttcttcctgcctcttgctcccctacttcttcttcctattccctgctccttgtccccgttgcctacttcctatcccttggtccttctacatattccctactcttttgtaaaatgttttattttattttattttatttttgagacagagtctcactctgttgccccagctggagtgcagtggtgcaatcatggttcattgcaacctcaacctcctgggctcaagtgatcctcccacctcagccagctaagtagctgggactacaggcacatgccaccatgctcagctaattttttgtagagacggggtttcatcatgttgcccaggctggtccggaactcctaggctcaagcgatcctcccagctcagcctcccaaagtgctgggattacaggcgtgggccatcaggctctgcctgcatgttccctgctatcaagccctgctccagctcctgttcccactcttcgtggttccctttctgtttctactcttgtcagaactacatagttacaaaacagccaggaggtgctgctgccctaccaggcaccaggaattaatgagaaaagttgctgttaaggtagtatggctttggtacaggtttacagaaagtggccaatggaacagaatagagttctgaacctgcag[139 bp omitted]tctactacaaatgcaaaaattagctgggtgtggtgggatgcccctgtaatcccagctacttgggaggctgaggtgggagaattgcttgaactcaggaggcggaggctgcagtgagccaagatcgcgccactgcactccagcctgggcaacagagagacaccctgtctcaaaaaaaaaaaaaagttagtatatatatgacagaggtggcatacaagctcagtgggggacaagggcttacctataaggaaaaagatgaactcaatccctacctccttcacactgtatatgaaaaggaatttcagaagaatgaagaatttagatggcaaaaacgaaactttactaaaaagtccctctttgctctagtgacttgagtcactactttgatcatacactaaagttccatatgtacatggatctataactggacttttgtttttcttcctttaatctgtcagcctgtctattcatgggtcagcatcacactatttaaattataaaagtttcaggctggacatggcggctcatgcctataatcccagagttttggggaggccaaagcaggaggattacttgaggccaggagtttgagaccaacctaggcaacatagcaagaccgtgcctctacaaaataaacaataaaaaaattagctatacatgcacctgtaattatagctactcaggaggctgaggtagaaggattgctggaacccaggaggttggggctgcagtgagctacaatcatgccactgcactccggcctgggcaatacagcaagattttgtctcaaataaataaataaataaataaataaataaataaatgaaatcttcgtaaaatgtctggtggcagaggcatcagactccctgtgggctgggagtatgagtccttattatcacttttctttttcagggttttcctagtttttcttgcatgttcgcttttccatatgaactttactatcaactcatttagctctagatataagtttgtaggtatatttttgggaaccacattaaatatataaattaaataaggacgtgagaaggtgaactgccattttcatgatgttaattcattctacccgagaacaaggaatgtctttccatctgcctaagtctacctttgtgtctttcaggagtgttttaaacttttcctcatatcactttgcacatcccttgttgatcttatcccaaaatatcttattttttttgttgttattgtatatgttttctcttctattataccttctatctggttatttgtgtatataaaaactactgatttctgcatgttgatttcatatgctgctgttactgcattcttttttatttttattttttgagacaaggtctcgctctgtcacccaggctggagtgcagtggtgggatcatagctcactgcagcctcaaactcctggacttaagtgatcctcccgcctcagcctcccgagtagctgggactacaagggtgcaccaccatgtctggctaattttgtgttttttttgttttgttttgtttttttgatagagatggggtttcaccatgttgaccaggctggtcttgaactcctgggctcaagtgatccttctgccttggcctcccaaagtgttgggattacgatgtaagccaccgtgctcacccttaatgtggttttgaatttgtttgctaatattttatttaggatttttgcattgatatttatagtaaaaatggtctatgctttttttttttttttgagacaaagtctcgctctatcacccaggctggagtgcagtggcatgatctcagctcactcaacctctgcctcctgggttcaagttattctcctgcctcagcctccggagtagctgggactacaggcgcacaccaccacgcccagctaatttttatatttttagtagagatggggttttaccatgttggtcaggctggtctcgaactcctgatctcaagtgatccacctgccctggcctcccaacatgctgtgattatagccgtgagccactgcaccaggtctatgcttttctttgtgctattaatgttataattgctttagaaaggtaatatggaagtttgtcttcattttccattctgtggaacaatttatgtggccattgggattaactagtctctagcatttcagtggaattcccctgtgaaatcatctgggcctgatgattttttatggggaagttccttaaaaactttctctatttcttttatggaaattggtttgttaacctctaatggggtcgattttggtaaactgtgtttccccaggaaattacttattttcatctaggttttctattttatctgtggatgccttttttatattttgacttttagaaccacgctaacgtcttacatttaaaaatataaaattaaatcagcattaccaggcgtggtggctcatgcctgtaatcctagcactttgggaggccaaggcaggtagatcgctcaggctcaggagtttgagagtagcctgagcaacatggtgaaacccaatctcttataaaaaatacaaaagaattagctaggcatggtggcacgcacctgtggccccagctactcaggaggctgagg[131 bp omitted]gtctgtaatcccagaactttgggaggcagaggcaagtggatcacctgaggccaggagttcaagaccagcctggctaacatggtgaaccccatctctactaaaaatacaaaaataattagctgggtgtggtggcacacacctgtagtcccagctacttgggaggctgatgcaagagaattgcttgaacccgggaggcagaggctgcagtgagccaagaccacaccaccacactccagttgggtgacaaagtgagactctgtctcaaaaaaaaaaaaaagaaaaagaaaaaaaaagacctcccttttagaaggggtcctgcccaatacccagaaggaagggatgttgcagagagagtctaaggctctgaacagacaggccttgctgggtttccccactcagtctgttagtacaagatcacaccctttttgtcccatcacatttctttctttcttttcttttctttttttttttttttgagacagagtttcgctcttgttgcccaggctggagtgcaatggtgtgatctcagctcaccgcaacctccgtctccttggttcaagcaattctcctgcctcagccgctcgagtagctgggattacaggcatgcgccactgcccctggctaattttgtatttttagtaggtacggggtttctccatgttggtcaggctggtctagaactcccgacctcaggtgatccgcctgcctcagcctcccaaagtgctgggattacaggtgtgagccactgcgcctggctgtcccatcacatttctatacagttataaatcctgcctatgcaatgaagtctccatgaagggctgaagaggatggagttggagagcttctggatagccgaacatgtggggttcctggagggtggctacctgggggtggggcatggaagctctgtgctctttcccacatgcttcgtcctctgcatctcttcatctgtatcctttgtaatgtaatactctttacaataaaccgatcatgtaaataagtgtttccctgagttccatgagccacactagcaaactaattgaacctgaggaaggggttgtggaccccgatttatagctagttggtcagaagcacaggtaaaataacctggggcttgccatcagcattagaagtagggcttagtcctgtgggactacacccttaacctgtgtgatctgatgctatcctccaggtagatagtgtcagaattgaattgcaggacatccagctggtatattaatttgctgcagaattaattgcttcttggtgtgtgtgtaaaagcctccacacatggtattgtgagagcagaagaaaaaacagtttgattcttctactcacacacatataacaattttatatatacacatatatgaaattatatatatatacataaagaaatgaaatgtcctagctgtgtacaatgagagggccttgaagcaagaacattccagtagcaatgagtaaatctagttcccagatcttggctttgaaatactattatctttgggctggggccgggaaagaacaagatatgcctggaggtgatgtcagcagaaatgtaagagcctgtcttctcctccttaaaattgcttaaaagcaatgagaacactggcaaaaattgtcaaaacaaacttatcagaactctggaaattgaccaaggtttacaattcagaaagcattttttcaagaaaatggctgaatcttggtaacaacaggaagctgtggcatttgaacttctcttgtacacatccccttctcctcacctccacaagagccttgaaaatcaacagccctgcaattccagtgaaaaccagcagactagcaaccattggaggaggcagaacagggttggagttcctccaaaatctcatttccagagaactgtctttatttgatctgtctggcactatcctgaatactccactcatggggctcatctggtataaacagctttctctgggggtgcttttcagaaacaattagcagcaactgtttaacacagcagtgataacatttaggaaaaaacaacaagcttttcaagaaaacttaaaaggaaaatctaggtaattatatatccattatcagtccattattaggctttaaaaagctctgacatatgcctgggaatctagaaaaccacaaatacgcataaggctgtatgtatgcctaggatctctggctgacctcaaaactctgcacaagcaggaaatgaaggataaggcaaagttgtaaacagcctgcctttgcattaaaggcacaccctgacatgcacatagagcccatcagcaaagtctgggagacttactggtttcaggtgatttaaagaaatatctgtccaatcattagctgaccactaagctaacggagcagagacttgggtagccacatatgacaaagaacacaggctttacagaattagttcaggaaggtcactaaaaacaaaacaaagcaataaaaacaaatcctgaggaggggagagaacctgattcccagagttgccacattatattatttaaatgtccagttttcaacaaaaatgtatgagagatgcaaagaaacaaaattaagtgtggcccaaacacagggaaaaaagcagtcaaacactatccctgaggaaacccagatgttagacttaataggcaaaaactgtaaatcagtgatttttaatattttcaaagaactaaaggaaactatgtttaaagaacttaaaggaaaggataaaatgatatcctaataagtagagagtatcaataaagagaaattacatgaaaaagaaattctgggccgggcatggtggctcatgcctgtaatcccagcactttgggagactgaggcgggtggatcacctgaggtcaggagtttgagaccagcctggccaatacggtgaaacccccctctcaactaaaaatacaaaaattatccaggcatggtggcgtgtgcctgtaatcccagctactcgggaggctgaggcacgagaattgcttgaacctgggaggtggaggttgcagtgagccgagattgtgccattgcactctagcctgggtgacaggagtgaaactccatctcaaaaaaaaaaaaaaaaagaaattctggagataaaaagcataataactgaaatgaaaaattcactagaggggatcaacagtagctttgagctggcagggtaaagaatcagtgaatttgaagacaggtcaggtgagatgatccaatctgaggaacaggaagaagaaaagtaaacaaaatgaacacagtcctagaggtctgtggaacaccatgaagcatatgaacacccacataatggaagtcccaaaaggagagagaaaagagagaaaaaaaggtgcaagaaagactatttgaaggaataatggctaaaaatccccccaatttgatttaaagcattaatctatgcattcaagaagtgcactgaactccaactaagataaattcaaagagataggcacccagacacatcataaacttataaaagctaaagacagagagaatcttgaaagtaagagagaagtaactcatcatatacaaggaatcctcaataggattagcagctaatttctcattagaaatcttgaagtcagagggcagtaggacaacatattcaaagtactgaaagaaaaagactgccaaacaagaattctacatccagcaaaattatctttcaaaaatgaaggagaaattaagacattcacagataaacaaaaactgagatagttcatcactaacaaacttctacaaaaaatgctaaacggagtccttcagggtgaaataaaatgatactagctagtaatgtaaatctacataaagaaataaatagcacctgtaaagttaactacataggtaaatataaaagacagtataaatgcatttttttgcgtgtaacacttttttactcctgatttaaaagacaactgcataaagcaataactataactatgttcatgggcacacaatgtgtaaagatgtaatttgtttgacaataatagcacaaaggagggatgaaggaataaagttatatagaggcaatttctttgtattactgagcttaatttggtattaattctaattggagtaatataaataatgatgttaattgtaatacccaaggaaacaactaagaaaaaaaaaaaacaggctaagtgcagtggctcatgcctgtaatcacaacactttgggaggccaaggtgggtaacttgagctcaggagtttgagaccagcatgggcaacatggcaaggtcctgtctctacaaaaaaattaaaaattggccaggtgcggtggcacacgcctgtaatcccagtactttgggaagccaaggtgggcagatcacaaggtcaggagttcgagaccagcctggccaacatggtgaaaccccgcctcaattaaaatacaaaaaaattagctgggtgtggtggcaggcacctgtagtcccagctactaagaaggctgaggcaggagaattgcttgaacccaggaggtggaggttgcagtgagccgagatcgtgccactgcactccagcctgggtgacagagtgagactttgtctcaaaataaataaataaataaataaataaaaaataaaaaactaaaaattagctgagcatgatagcacatgcctgtggtcccagctattcaggaggctgaggcaggagggtagcttgagcccaggaggttgaggctgcaatgagccatgttcctaccatggcactctggcctgggtgacagagcaagaccctgtatcaaaaaaaaataaaaattttttaaattaaaaaaatgaataaaagacatagggaagaaataacagaaaaattaaaaatggtacactagaaaatatctgtttaacttaaaagaaggcattactagaggaatacaggaacaaaaaataagatatagaaaacaaatagcaaaattgcaaacataaaccctaccttatcaggaattacaataacataagttaattaaacactgcgattaacccttttcctgtttaggaaaaaaaaacgtgcagcttgctgcctgtgctcactagattttatataaacatgctctttgaggctgaagcaaagctaactgattttcaatgtcaaaacaaaatataaaaactattcttggagttatttctaagctgaactaacatcagaatcatctgaatcatcagaatcatctgaatcatcagaaccatctattttggaaaaatcagattcatcaaatgattcttcatccaacgactgttcaagaacgatgttaacatcatttgtagggatgttacattttctaggatttgacattttcaatgattgagaattactatattttgtaagtggaaataccactcctaaaaacagaatgctataaatagaatgatgtcttttgtttccaaagtcgatatactagagtgatgtgaaaataataataaaaatgagacagtttgtggcaaagttatctcagggtaaacactgcagccgcaagtgccatcagagagtgttctcagcacaaacggtaaagggttaataggcacagtggatgaaaaacgtgacttaattatatgctatctgtaagaggcacattttagattcaaagacccaaataagttgaaagtaaatggatggaaaaagatttaccatgcaaacaatagccaaaagagagctggaatagctatactaatatgaggtaaaatagaatttaaaacagcaattgttacttgagataaagaaaaatattttataagcataaatggtcaatccatcaagaagatttaacaataataagtatatgtgcacctaacaacacagcacaaaatatatgaaataaaaacaggcagaattggagacagaaatagacaattcaacaattatagctgaagacttcaatatctcatttaaagaaatgggtaaaacaactagacagggaaccaaaaaggaagttttttttttttttggagacgtggtctcactcagactggagtgcagtggtgcaatctcagctcactgcaacctccactttctgggctcaagtgatcctcccacttcagcctcctgagtagctgggactataggcgtgtgccaccatgtggctttttgtgtgtgcatgtgtattttttgcagagttggggttttgccatgtagcccaggatggtcttgaactcctgcactcaagcaatccacccgcctcagactcccaaggtgctggaattagaggtgtgagctactgtgcatggccaataaggaagatttgaaaaatgctataaaccaattagacctcataaacatctatagaacacttcaccctacaatggcagaatacacattcttcttcagtgcacatggaacattcttcaggacagactatatgttaagccagaaaacaaatctcagtaaattgaaaaggactgaaattatacaaaatatgttctctgaccacaatggaatgaaattagacatcaaaaacagaagaaaatttgaaaaatttacaaatatgtggaaagtaacacactcctaaataaccaataggtcaaagaagaaatcacaagtgaaattagaagatactttgagatgaatgaaaatgaacacacaacatatcaaaatgtaagggatgcagttaaagtggtgcttaaaggagaattcatagttgtaactgcctatatctaaaaagaagaaagatatcaaaatcagtaacctaatcttccatttttttctaggaaattagaaagaaaagagcaaactaagtccaaagcaagcacaaggaaaaacataataagagtagaaataaatgacataaagaattttaaaaatagagaactaataaaacaaaaatttggttctttgaaaagatcaataaaattgataaacctttagactaagaataaaaaagggcagaaaattctaattactaaaatcaggaatgaaagagtggacatactactgaccttacagaaataaaaagtattataagagagtataagagagtactgtgaacaattatgtgccagtaagttagaaaacctagatgaaatggacaaattcctagaaagacacaaactacaaaaactgactcagtaagaaatggaaaatctcaatagacctataacaagtgaagagattgatttaggaataagtaaaacttcctacaaagacatacccaggaccagatgtcttcactggtgaattctactaaacatttaaaaagaattaataccgaccaggcatggtggctcacacctgtaatcctagcattttggtaggccaaagcaggaggatcgcttgagcccaggggttcaagaccagcctgagcaacacagcaagaccctgtctcaaaaaaagaaaaaaaattaatgccaatcttcacaaaatcttcccaaaaatagaagaaggaacactgtccaacttattctatgaggccagtattatcctgataccaaaaccagaaaaagacatcataagaaaactacagagcaatgtctcttacgaatatagatacaataatccttaacaaaataatcacaaactaaatcctacaacatacaaaaaggatttataccaaggccaagtgagatttagcctaggaatgcaaatgtctacacctagacacatcataaacaaacttatgaacgtatcaacttgcatgaaaatcaattaatgtactacataccatattcatagaataaaggacaaaattcacacaatcatgtcaataaacacagaagaagcatttgacaatgtccaacatcctttcacgacaaaaatactcaaccaactaagaatagaaggagaaatttgtcaacactgaggtagcagttaatatatgccagatgcattgttctagacaccttacatttactaagtaatttcattctcacaccaactatatgaggcgggaactattattacctacattttgcagatgaataaactgaggtacagggcgtttaagtaacttttcctgtgttaagcaactaataagttgtggaggtaagattcttatacagaaattctggctacagagtccatgctcttaatcacattctgctctactgtctctcaaagaatgtagactaataataatgataaac[136 bp omitted]atacaaaaagtagctgggcgtggtggcacgcacctgtagtcccagctactcgggaggctgagtcaggagattcgcttgaacccaggaggcggaggctgcagtgagctgagattgtgccactgcactccagcctggcgacagagcgagactcctcctcaaaaaaaaaaaagaaaaactaatgattcaatctttatctgtaagtaaacttaacttacaacactgttgacgtatatcagtgatcataatttgtagtactggtaagaattgctaatattagtagcaatgtttatttaatcaagttgatagtgttgggtcaatatttatatttaattgtaattttagtcataaaattggtgatgatcatttatatgagtaaacataatttgtaatattggtaaaaattgacaaaattacttatacaatttgattgcattagtaacaattatttaatttctatttgtaactaaaatttgattcataactgtggtactcataatttatattagtaatcaaaattttaatattagtgattttttttataatagcagttagaatgttaaccatattagtaattatttctattaggaactacaagataattcaaaacacaggtactcatgggttatattagtaatcttaatttgtaacactggtaatagttatatctgtaaaaatttttacactgtttgtactaatggtttaattttatttacttatttatttaatgttttgagacagggtctcactctgttgcccaggttgggatgcggtggtgctatcatggctcactgcagcctcaacctccagggctcaagcaatcttcccacctcagcttcccaagtagctgggactacaggtgtatgccaccatgccgggctgatttttaaattttttgtagaaatggggtctcgctatgttgcccaggctggtctcaaactcctgggctcacgagatcctcccactttgggtttaaatttttaaaaaataattataacaatttacaacataagtactaatcatttatagtaataaacttaatttgtaacactgtaatgcattgtaatattagttgttatatttgatgatattagcaatgataattcaatttctattatttaaacgttcagcatattttattctggcacattgtagcccaatgacccaactgtggtagtctccactgcatgccatgtttatgtaagtcaaaacaggtacttataatttatattagagcataatttgtaatagcaataatcatttgtaataacagcaataatctttgatgctattagtaatgattattcaatttctactagaaactataatttaattcatgacataggtactcataatttacaacagtaaaaataatttataatattagtgataatttgtaatattagtgattatatatatatatatattttttttttttttttttgagatggagtttcgctcttgttgcccaagctggagtgtaatagcgtgatcttggctcaccacaacctccgcctcccgggttccagcgattcccctgcctcaacttcccaggtagctgggattacaggcatgcaccaccacgccgggctaattttgtatttttttagtagagacagggtttctccatgttggtcaggctggtctcaaactcccgacctcaggtgatccgcccacttcggcctcccgaagtgttgggattacaggcatgagccaccgcgcccggccagtgattatatttcataatagtaaccaaaagttcaatttctattaattaattaataggagggaggctgaggtgggactctgttgcccaagctggagtgcagtggcgtgatctctggtcactgcaacctccaactcccgggttcaagtgattctcctgcctcagcctcccaagtagctgggactacaggcacgcaccaccatgcccagctaatttttgtatttttagtagagacggggtctcattatgttgaccaggctggtcttgatctcctgacctcatgatctgctcacctcagcctctcaaagtgctgggattacaggcatgagccaccgtgccttgccaacaatttaatttataacattattattgataaatgttattggcaatcctaatttgaatataggtaaaatttctatcagaaggaatatttgataatgttagtaataatgacttaatttctatatgtaatatattctgattcattacattaattctgtcaattcacattagaaataggtttttaatactggcaaaaatagacaacatgagtaacaggatctgatacatattagaatggatcatgatttagttttccttgtaagcataaggaaattcacggtagaccctatcacaaagcaacttcatgactccacgtgcacacagcagccacactcttgatatcgcactgctgataatataccaatatttaatattattgcagtagttatgactcttccctcctgcccactctattttccccaaactcaccatttctttgtgattggggtagaaggtctgatcaattagagggaattcttctgtccccagtttcttatgcagtcgaaccatctgggcaaactatgagaaccaggagagctgggtcagtgagtccttcaccacgaatctgtaagtttctgaacaccctcacttccccaaatcgcagactggtttcaagctcccacatacatgcatgagctgttccctctgccagtggcacccttcctgttacttaccacccagggcttgtcacagaagttgtagacagaatgcaaggagttaacactggggattccagcatactgcagcccaatgaccaaactgcggtagtctccgttgcgtgccatgctgaaggcgtgctggcggatcagcacaaaatccggcttcagagacctagtgtggcaggggtaggagtgttgagagttcccccagaagctcccaatcactctcgaaacaaagaccaagtttttaaatctccatagctcccagaaattgcaaagtggtttctcacctctgcacacatgtgtgagctgttccctctgcctagtgcaccctttctaccctctgcccacctggtgatcccctttaagcctctcctacctgttcccttctcagcaaggtcagcttgcagcttaccgacacagctctgacaactccctggtcaccatctctcagactgcaagctgtcttcagtgttctgcccagaataaattctaaccttgggacctttaccaaggctgttccatctgcctaaagcacttcccccctagatatctgcatggatcactccttcacctccatcaggtctttcctcaaatgtctctcctgcaaccaggccaccctatcccaactgcagaccccaccatcatccaacaattgctacatctgctttagtgctatatatatatttttttcttttttttttttctgttgagacggactgttgctctgttgtccaggcgctggagcaatcatggctcactgtaatctccgcctctcgggttcaagcgatttccctgcctcagcctcccgagtagctgggattacaggcacctgccaccacgcctggctaatttttttatttttagtagagacggggtttcaccatgttggccaggctgattttgaactcctgggctcaagcaatccacccaccttggcctcccaaagtgctgggattataggcatgagccaccacatccggccactgttatgttttttcttagcacttttacattttcttatttatttgtgtattgtgtgtatctcacagtagaatgtaagtttcataaggcccaggttctttttctttttttttttttggcctttcagcatgtagaatatctcctggcacacagtaggtgtacaataaatatttattgaatatgaagtcctgagagcagcatctggcatgcagcagatgtctagcaaatgtttatttaattaataattgaaggctgggtgtggcggctcatgcctgtaatcccagcactttgagaggacaaggcaggtagattgtttgagcccagaagtttgagacaaacctgggcaacatagtgaggaccccccccatctctacaaaaaacataaaaattagctaggcatggtggtgcgcacctgtagtctcagctacttgggaggctgaggtgggaggatcacttgagcctgagaggttgcagctgcagagagccatgattgtgccagtgcactccagcctgggagacagagcaagaccctgtctgaaatatatatatatatatatatatttttttttaaagtctgacttgtggcatcctggggtccctggctctttttctgaagaaaagttgtctccccacattccatgcctaagttcttgcccacagaaggatgggtggggaggtaggaactttcccccagctctaagggagagttcttatgccttgctcataacaccaaggtacccttcttatactcaccgcacgaccttcaccccattccgaagaacttccatatccacagagaatccaccattggcatgggccacaaggttgagatcagagaattcggcctgggaaggagaaaaaaactggtgattcacctacatcacacaaaaatggccactcagtttgcagtatggacaactgacccccaggtccaaatgtcccaacttacctgttctactttaatgtcaatttctccatggatctttttccctttgaagtattttgccctggagaggaaaaacaacacatctgtcaatgatgaaatctcagaagggaagacaaaacacaggcccttgacccttttgccccttcaatgctactaaagaaaccacaaagtgccttataattattgaaatattttgaaaaaatcaagagtgctttgtgaataatgtctgttgtaatcctcatggagttgcaaaaatattaaaggacattgcaaactgtaaaatgtggccttacactgcagagagcaggtatttcccaaaatttagtctgctcatcacattgtcattgtaaattttttaaaaaaacttcacaaaattagcagcactatgtaaattagaacatactttgaaattgcatggagaccggtaaacagcaaagaaccttagaaaacacctatctggccaggtacggtggcttacgcctgtaatctcagcactttgggaggctggaggtaggaggattgcttcaggccaagggttggagaccaccctggacaatatagagagacccccatctctacaaaaaaaattgaaaaaaaaaaaaaaaaaacaaaagccgagggctgtggctcacgtctataatcccacaactttgagaggccaaggcgggtggatcacctgaggtcaagagttcgagaccagcctgaccaacatggtgaaaccccttctctactaaaatacaaaattagccaggtgtagtggtgcatgcctgtattcccagctacttgggaggctgaggcaggagaatcacttggacccaggaggcggaagttgcagtgagccaaaatggtgctattacactccagcctgggcaacaagagcgagactccatctccaaaaaacccaaaaaacaaaaactagccaggcatagtggtgcatgcctgtagtcccagctactggggaggctgaggcaggagaatggcttgagcccaggaggtcgaggctgtagtgagccgtgattgcaccactgcactccagcttggggaacagagcaagacctaggcaaaaaagagaaagaaataaagagaaaggaaggaaggaaggaaggaaggaaggaaggaaggaaggaaggaaggaaggaaggaaggaaggaaggggaaggaaggaaggggaaggaaggaaggaaggagagaaagaaactacatttctctgaagcgtgcctgtttttgtgtattttttagtgcctgtgtatatgtcagtgcctgtgtctggctgtgtggcctgaagcatctctctgctctctggccctttcgcaaggaggagcacattcaccatgtgtggttgtgtgctgtgagaaacacaatggccataggtgggcagctgcatccgataaggaggagtggattgagtggtgcaggctgggtggctctagagaagccagtgtagctggcaatgatggggggcagggaggaatgcagctgaggaggagagggagcaacaggagggagggggagtgggagcagcagtaggaacatcacgaactgctatgtcattgtccccgggcccgtccccagctgggcttggtttccggtggcctcctcccccaggctcaagatttctagccaacaggctgcttgctccagggatggaagctcatcctcaatcaggtttatcatggaagggggatgagggggagagacactttcagggctactggtcactgacacacatacaatcagggtcttggacagacacacacacacacacacacacacacacacacacacggcacaaatggaccctggtgacttgactgacatatgcaagagaccccaagtacagctacttctttttccttgctctctctctgacacacacacacacacacacacacacacacacaccatcgctgacactatcccctcagaagtgttgagagagaatctctctcagccctgcacatttttcatctataaactgatgagtggggatgatgagggtgtatcactgtttctaaaacttttctgaccataagtgtagttggatactgtggtggtctgctcaggcctcctcttcagggacaatgtaccttgaatggcagctactgacagctcatggctgtgtccccactgggaattgtcttgtcacagggaactgccttgtccaaggttacacctacttcatgagggcatccccatggtctggtctatgaagggaaagaaaggccagcctccttgcctcaatctgggctgactctgaaggaccctcccagccccagggctccccctaagagcagcggaggcccctaaggcaactacatcttgagccagcctcttcctctgctcaacccaaccctcctcacaagtgttgatcccaatggcacactccagtaagcctcctgcatgcaaatctccacctcaaagtctttttccagggaacccaacctaaaacagtgggccatggaagtcaaactacaagggtggtctaatgcaattctggagctgggttacccagcagccagatggcagtgaggacccatcagtagtgggaggtggggcatagatagcctccgatatgctgtagcaacgcaaagtgctctgcagcaggtccgggctgtggtgcaagcaggatgtgacttaggccatatgatccagcagatcctatgacactggaggtgtcagtagtaggaaaagatgctgtgtggaatttcttctcccaggtgggagaatacagcgcaggcccccagggttttggagtagcggtgacttttcctgatggtgggctgtaatgggattctggtggaagggaatgtactggatggtgaaatatccctggaacttgagtgatgtcagggaaatggtaaccagacttgggtgactattccctaaacgccattgagtagctgaagaaagacctgacatgctcagggtgaattcaaggcaaaatgtgaaagccagaggatctccctgactgcatttaaggaaaccctcatctcctgcagtcagagggcagacagaagggagggccaggctcagaatttaattctacgtggtggcggagcttcggagaaagttgacttctcaggcccagcacatctcctgggccatgctcatgtccctaataggacaggagtaggactctgagatggggatatctgggcagatgcagttaaacaccttgaacttacagactcacctgcatccactgggcctgctgaagtagactactcccctgagttagaatatagaccttctgcttgaagataatgcagaggcctcggatgatgcaggtgctttgtaagacaatgcctgcccccctcagagtctaccccccacctaccctcctggaaaccagaccaaaaattagggtgaaatcctagtgaaacctgactggacaggttctaggcttgcaaagggagagaaatgatctgtagaagaacctaaagaatctggctagtacgtattggcaggagctgggaaggtatgcatgagactggatcctgaggacaatgggcgaaggaggtagaacaggaagttggtgtgctctcccaggatacggaacttaaaaccctggcgaggactctaggaagtgttactaacacactggtatttggaaacctggagtaaacaatggcccacactaagtgaagcagaacttccatggcagattgcacagggaaggattaaagggctcaaagaagcagacatgttggagtagatatactactgaagtctggaaaacccaccagctgattaaggcctggaggatacactcaacttatgaaattaataagaaacatgctggtgagggtggtaccagtcacgctgagaagcacagtagtggtaaggtgataaatgagtcctggcccaggtcctgcttacagtgggtctggtgggtctagagacccacccagtggtcacttcctcagttcacaaatgcgtaattgcaatggcatactttgtagttgtcagaacccctacatgggctcctcagcctgtgggataagagctgtttcagtagggaagtccaaatagaagcttctaaaatggcgcacacccccatgccctgaacaaaacaataaaccacaaacaatattgtgtgcatcctatgggtgatgatggaaatcaatgccacattgaaagatctaaaggatgcaggggtgttggtctcatcttatctccatcgagttgagcagtctggcccctggagaggtcagatgggtcctggagaatgcttgcagattactgcaagcacaatcaagtagtacccttagttatacctgccatactggacacgctgtcattgccagagcagattaataagacctcaggtacagcaggtggctgctgacttggcaaatgcattcttttttattctgattagaaaaaaggatcagaaacagtttacactcacatgagactgatgataatattcatagatggtcttgctgtagggctatgctatctctctcacctggtgtcataatatagtccagagaaacctggactatctggacatcccatggaatagcacactggaccaccacatggattacatcatactgattgtgcaagatgagcaagagagggtgagcatattgccctggtaagacacatccactacagagggtggaggataaactccacaaagactcaggggaccgatgcattagtaaaatttttaggaatccagtggtccagggcagtaaaccaggacagcccctccaaagaatagagcaaagcattgaatcacgcaccttccaccatgaagaggaaagcacaatacctaggaggcctcttcccattctggaggcagcatgtcccccacacacaaataatgctctgacccatattccaggcgacatgtaaagctaccagctttgtgtgagggccagagcagaaaagggctctgcagcaggtccaggctgtggtacaagcagtcctgccatttaggccagatgatctggcagatcttatgatactggaggtgtcagtagtggggaaagatgcagtgaggagcttatgggaagcctgagtgggaggcccttggggttctggagcaaagccatgccatctgcagcagagaattttacgccttttgagaaagacaccccattgaggtgctgggccctgatagagacagaatgcttgaccaggcaccaaatgattgtgcatccagaagttcccattataagctgggtcctgctgggcccgccaaataataaagtcaggtgggcccagcagtcaggattgagcccaagcagaaccaagcaaggtgcatgagcaggtaagtaaccctgatccccatgtcttccacactgttgtgctagtgcctgtctcactaaggggactccttaaaactagctgatgaaagagggaaaggtctaagcttggttcacaaattggttgtcttagtatgtgggtggaagccaaaaatgggcagtggttgcactataacccaactggaatggccttgaaagacagtggcagagctcccagtgggcagagcttcaggctgtgcacctgctcatctcctttgtgcagaaagagaagtgcctcaagattagaatacatatatccacttatgggcagtggtaaatggtttggctggttggtcaggggcctggaaataaaaagactggaagatccagacaaagaggtctgggatacagaa[144 bp omitted]tgaaaccccatctctactaaaaatacaaaaattagccgggcgtggtggcgcacgcctgtaatcccagctactcgggaggctgaggcaggggaattgcttcaacctgggaggtggaggttgcactgagccaagatcgtgccacagcaccagcctgggcaatagagcgagactccgtctccaaaaaaaaaaaaaaaaaaaaaaaaagggaggagcgaggatctttggatcgtgtgttaacacccaccagacagcatctgccatggcgccatggaagtgacactaggcaaccaggtagacagcatgagtcagcccgatgatgtcagccaggctctaatcagccaccccagtgttagcagatgggcacatgaataagtggcaatagcagcagagagagaagctatgtgtgggggcagcagtgttactgctgaatgtccaatctgccagcaacagagactaacattgaatccctgacacgccaccatccctccagaaggccaaccaaccactttgtggcaagctgattagattgggccccttccatcctgcaaagaacagtaatcgattttgactggaatattccatatttgagtttgccttttcttactgcaggacctcagccagctcactgtctaagggcttacataacgtttgatccaccagcacgagaccctgcataacactgcgtcaaaccaaaggacacactttatagcaaagtaaaggaatgcaaagcaaaggaggtgcaaaagtgggcccatgaccatggaattaactgatggtattacacaccacgccacccgggagctgctggcctgatggaatgatggaacaatttggtgcagccacagctaagatcccaggttgaaggtgagatcatgcaagaatgggcaccatcctccaaaacagtgtcaaccctaaatcaatggccattgtaggtgctgtgttcctaacaggtagaatacaccggtttggggacacagaggttaggaaggagtggcccagcttaccagcaatcccagtgatccacttttgaaattgtgcttcctgttccctcagggctctgcaaggttagaggtcctggttctccaagggggaacactgctaccaggggacacagcaagaatcccattaaactgtaagctatgattgccctcagggcacttcgtgtttctcatgccaagggacataaaaaggagccattgtcttggcaggggacgtgaccaaccttgctcctcaggaggaggtagagctgctggtacacagtggaggcagggaggagtatgtctggcacccaggggatccacttgggcatctgttggtactccttgctcaactttgatagtaaatgggaaatgtggttgtttgtacagcagctacagcctgagaagggcatggggaccaaaggctcagggatctctgcaggatgggagccacccagaccaagagtggtgctagctgagggtggggggaatctagaatgggtaacaaaagaaggagaggatgaatatcatttatgacgttgaaatcaactgcagcagcagagactatggctcatctcactaccgtgctctttcaagtgtccctgagaaaacaagaccgattagaattctggaaatgccgttccccaatggggtgaacttactataagaaggaagtggatcggagcagtgcaaggtgtggactatatgctccccccagatccttacctccttgttccagacctttgcatctatcctcagcttctggaattatccgctgctgatggctcataggtgtccctcactgggcattggcctctgcaacagggatttgcctcacccaagattacgcctcctcccagggggcagcctacagccaatgactgacataggaattcaaagcctggccaccccgcttcaactgggacaactctgaagggtcattccagtgccagagctccccagaggattggccgaggcctcttttgtggttgcatcacagctcaacttttccctctgcacaatcctgcttccctcacaacctcccccacaggtgttattcccaagcgctctccccagtaaatctgcatgcaaatctcagagtctcggggtctgcttccagggaaatatatctgagaaaagaagccacagtaagaaataaagcttatataacccactatatatgtatttgcataataactcatcctatatatgtattatataagacacatatgttgtacagcaaatatgagaatatagaatgtcttatatattatgtaacatataaaatgttgtatattacatattatgtgtatatgtatttagaatgtatataaatacatatgcataactggaattaaagtttcaatagataattacctttactatgtgtaatgcagtctgatttttctatgctattttatttcatttcatgaagaagaacatatacatatagatgtattatgtactgtaaagccattgtataacacatgtattacataccgtatgtcatatataatatacattacagattgtatatcttaatggaataacattatatgttttgctaaacaacaactccatttactatgtgcaatatgctctgttattctctatttttatttatcctacttcaagaagaaagtgaaatgctggtcataagccaataggtgacccatagtttgagaaacaccagagagccgggcacggtggctcaagcctgtaatcccagcactctgggaggccgaggtgggtggatcacgaggtcagaagtttgagaccagcctgaccaacatggtgaaaccccatctctacgaaaaatacaaaaattagccaggcatagtggcatgtgcctgtagtcccagctactcaggaggctcgcttgaacccaggagacggaggttgcagtgagccgagatcgtgccattgcactccagcctgggcgacagagcaagactccgtctcaaaaaaaaaaaaagaaagaaaaacacaggacaaaattacccacaaaatgggggagatgagtctcaacttagagttttcaactttaaaccacagaggaattgagacccaggaaggaatgagggtggtgaggtttggtggaaaaggcgtcagactgtatttcggtgtacattccatcacagagtttgcacaactcctgctttatttggggctgaaatccctgaagctagtgtggttctgagtgtctgcaagttggtaaaacaggtctctgttccccacactgagcctggcgtacatacataggctctgtccctttgtccaccccaccccacatatagtagacactaaataaatatttgctagattgcctggaagaaaagactggaggggatgctgggataaaggggggcttctgagatgcagaaggggaagggatggatctttcactgaattcagcaggtgctcaataaatgttttctggacaaagaaaaaatggaaaacattgaatttgtgattatggaaaggggaagggacttgtcagtattccatagataataaatgcttgatggaaagaaggaagcagacgcaaaggacctgcatggagggctggagtggagaccggaagtctaaaggagggtgattacctatatccagcagaggcctcattgatgtttgctgacttcaatggagcaaacttaaccaggaagataacacgttggtgagtggacgttggtgaaggaattacagcacgtgctccataaatgctttacagattgatagagaaaaaagcggagaagcctgctgcagggatgataatgtggctgtttgaaaataatacagtaagagattaataagtgttttctggactaattcggggagaaaaaggcagctggggagatggctactaagtggaggaagaggcctagctagaataaatggaaaacagtgcacattgtgagctttcaggattgtgttgtgtaaaaggcaggatggagattgttgaagggggaattgggactacaaaaaggggagaagaggcatttaacgcagggttctcagtagtatacgataaatgctcattaaatgattgtggggttgcatggaggaaaaggtatagcaaggccagctggcaggtgaggatttcaagcacacctgcatttagaaaaaaaagaaggaaggggagctgaagaagggttattcctagtatataatggtgcataataaatgcctcccacactttcatggaaaggatgcaataaatatctgcagaatgaataaattgctctgaatggagagaaaggctactcggtaaaggctcctgggggagaggtaatctaaccagtaaacagctggtactcaatacatttaggctgaagtagacccctagagagagagctcttgaggcagggtcagggatttccagagacttggaaagaggaagttgaaagtgacttatacagtaagtgctcaataagtgtttacttaaatagtaaaactattaagtaaatagtaaatttagtaaatttactaaatttatttagtaaattaagtcaatagtaaaactattaagtaaaagtgtttacttaagtaagtgttacttaaatagactaaaagccctttgggggtatgaattaaagttggtagagggaatcctaggggtactgaagggagtgggaaaggggtgatcattataaactcagctctggatttatcacaggaaaggaccttgggagaggccttgtgattggaacaggctctcctaggggtaaggaagaagaatgtactccccaaaacaacaggtcctgcatatgtgctcactggatctactgttaagaaaacaattctggggaggaggtgtgaatatacagaacacacagaagacactccataaatgctcaggggagccattggaagaaaaggtctttgggggaggatgattaaaatggagcacatgacagacaaggaataaatgctcactggatccattagaagaaaaggcctttggggagtggggctggggatggacatatagtcacctgatcaaggctcactgcatccctgaaggaaaagtcctatggggaggggaaatgggagtgcagaaagttgatctatgggagctcgattcttcatccataggagaaaaggcttttgtgaagaaggcacacaatcaggtacacagcaggtgctccataaatactccaaggagtgattaaaagaaaaggtctttggaaagagtgactggaatggtacacacagcaagtgccagatatctgagcactgtattaactggaggcacaggcctttatggagaggtctaaggttgggtcatgcagaaagtgctcaatacatgcagactgaagccactggaggaaagggtattgcagaaagggtttgagggtggggtatacagcaggcaccagtcaatgcatgcttgctgaatacactggaggaaagaacttttagagaaggctcacactgcaggcagttgataaatgctagatggatccaccaaaggaaaggtctttgaagaagtagctggagaacgggggatacaagaggcactcaataaatgttttctagatccactgtagggaaaggtctttgaggagacggtctgaagatgagtcacacaaagaaggttcaaaactgctcatggaactcactggaggaaaatgatttgtttgagaaggggtttgggggtgcggcacgtatcaggcacttaacaaatgcttcctagatcctttggagaaaaggccctcagagagagggcttggagttggggcacagagaaggcatccaatcaaaactcacaggatccatgaaaggcaaagcttttggagagaagctggggtgggatacacagcaggtactcaatgtttactaaatagtttaaaagggctttaaggacggagctggggtgggacacatagcatagactggacacatgctcacaagacccattagagaaggcctcagggcaagggttgaggagaacaggacagtatcaggctctcaaagaatgctcacaaacctcattgaaatcaaaggccttggggaagggctcttggatgaggcatactgcaggtactagataagtgctcacaagatccattagaggacaaggcctatggggcaagggttggggagggtaggaaggacacgttcggttttcgaaggctcataggatatattgaagccaaagacttttgggggaggggtagtagggaacaggtacgcagcaggtgcctgataattgctccctggatccatcaaggtttaaggggcggaggggggcgacaagggcggggcacagaggaagcatccagcttaataatttaaaggaaaaagatttaggtgagagggccaggtgtcaggcacacaagcggcgctcgataattgctcattcgcagaagaacgatctggggacccaggcccacgggagacgtccgcggcagtggcttaccagtcggtgtgcggctcgtcgatgaccagcagcaccctggaggcggctcccccgcggcctgcgcccccagagccgccgcccacctgctcgctgaaggtggcagctgccgccgccgtggtctgcttgaccgcgttggacagcgacgagaagaagccaccgccccccgaggacccggggctaggggcggccggagaggccgctggggcgaccccggaggacctctcggcagtggcggtcccgggaccgggcgtggctccggggctgtgggcaccgggcggcggtgggggcggctgcggacgctgcaggtctgtcatgtacccatttggcagattggccataaagttgctgtccgacaggcggcgccgcaggtagttcatggctgcgacttggggcagggggtcctaggggtggtctggccaggagccgcgggggcggactgcgcggtgcccaggagcacagctgcgctctcaggcacgacacgactcctccgctgcccaccgcagactgaggcagcgctgagtcgccggcgccgcagcgcagatggtcgcgcccgtgcccccctatctcgcgcctcgcgtggtgcggtccggctgggccggcggcggcgcggacgcgaccaaggtggccgggaaggggagtttgcgggggaccggcgagtgacgtcagcgcgccttcagtgctgaggcggcggtggcgcgcgccgccaggcgggggcgaaggcactgtccgcggtgctgaagctggcagtgcgcacgcgcctcgccgcatcctgtttcccctccccctctctgataggggatgcgcaatttggggaatgggggttgggtgcttgtccagtgggtcggggtcggtcgtcaggtaggcacccccaccccgcctcatcctggtcctaaaacccacttgcactcatacgcagggccctctgcagatactcggtttgtagtgttgatattcaactcagaaggcattttttggggggaggggggcactggaagcacactcagagacacgaaagtagagaaataaccccctcacagaggggggtgaggtcacacgcagtgcccgcggggagattagtctcccacatccacacaggctcagctaggcagagagcgggggcgtcacagacagcatcagacaagcggaggtggacacttgggtggtgtacacacccttgcccaaggtggcaaggggggcctggaggcacacaagaaatgacacacatataaacacacacaaaagtgaggaaacatacgagggcatgtacagacagaacacacgccaatctaggtatacatacagacatacaagtccagagtaacacacatgggcatgttacatacatgcatgcatacacccatacccccacacacacaggtaacacactgacacacagagacccagggaaactcatatgagcatacacttgcagacaaaacacattcccaccgatgatcatggagaaacctagatctgcaacacagacattctctgcagccctagccctggtgcgtgtccacccccacaccagaacacacttggtatatacgccaccatccctttgctctggacaccgccaaaactcacgataactacctgatgtcatcagtgcccatggctgtctccccctgcacccaagaactttccacagaggcaggcccatcccatggtgcacacacagtaggtaccaaataatgtttgcatatgagcaaatgaggtagtccaagcagaggtgggatatgggaacctgtcaaatctttatgattctgactacaataaaagcactaattcataatcatttgttcactgattgtacccaactcttaactaagctgtttacatgcatcatttcatccaaccctcacaacaatccagtggggtggataatataatgtctattttacagatgagggaatacaagaactccagttaattcccaaagggtcatgttcactttatgatcaacacatttttttaagaatgtgccaggaagaggaaacatccagtgccaatgtggctggaacaagctgaagggggttgtggtagcaggggccagattgggtaggaccttgaccatagtgagcagtgatggtggactaggagaggtggcagaagataggcaagaagtaagtagatatggagtctcttttgcctgcagaattttcaggtgactcatccacttattcatttgttcatcctttattcattaaatcattggctggtttaaacaaggcagtaatagtgtggggtctggagacacagtgcctgggttcaagtggggcctccaccatacacttgggaaagtgacttaatctttctgagatttggtttcctcatctgtaaaaaggatacatctctaacccacctctaaggagaggggtaggaagggggcaacctctgtacctttgcatgtgttgtaacttctgccaggaatgtcctctccttctctctcgagggctgcctttggccactgtctgcaggaacccctcacccccaggtctcagattctatcccctcctcccctaggcttccacagtacccaagtcaaacacttcccaaaccatcctctactccctcctccaacccagccagcttcagtcccacctccaggcctttgatttggccactcttttctcctcccttcaggattccttctctggcattccaaatcctagtgttacccagatggggatctccccgcaaatcagatattttccaatgtcttgaagtatgtgctccctggttttttgcccagtaacggaagcaaacaagctgtgcagggcgcggtgccctctttggggacaggaacagctgcaggtctacagatctttctgactcctttaggtctgaattcaggttcctcgggaatctatctccaggctgcgcctcttcctggggtccccattcctaggttcctagtacttgtggccccagcaccatttcatttttccacgtggctcaatttccagaaattaattttttgtagattgttttgtagaggaatgaggattcacctcaggagtgcctcaattcactaaggcaaaggttaggctcccccaaactgtctccatcttgttcagcaggaataggcgtacaaaaggggccccaataatgattttgctgtacattggtgagcaacgactctcaaacacacacccctgacatatgttcacattcagtattgtacccatgtttgtgactcacacatacatgtccatggcaccttaatgtgtatgtgcacacacgggactcctgcattgttatggcatacatacatttgtaacctcacacacatgccacatatcaatacatccttaattcttgcacaggcccaaaggtctgcatctctctctcacacacacacagctgaattcccactttcttgtaaacgtatacctctctcataccctgtagtagcaaccagaacccctcactttggctcagtcttcccaagatgaccaagtaagtactcatcaacttcatcttcacttcaactcattgactggtccacttgaataaggggaaaacgaaccagagaagtcaagtaagtgtaccaatatactctgggtgtgcatgtcacaaacctcctacccgaaccttcccacacagacgggtcccctccacccacagcactcttgacatttaagacctcatcacaatccatgatgcttcaaaaatgtccagcctactacctttctgtgcgtgtttcctttgtaaaatggggataataatacttacccacatgggtttgctgtggacgaaatgagttcatgctatggaaagccttaagacactactaagcacacagtaagtactttctaagtagtagctattaccatgattattatgattcttatgatgcgtctcttcacaaggggcccggcattcagtaagtggtaaatgaatgagcaaatgctaaaagcactggtgtctggctttgttccctttactgcggagacacgtaacgctctgattcctcttcttctctattctccgtgatgtccagcactattgttagtatacagtaggcgttaagtgttgaatagatgttcacacgaaaggaataccttctgagtctgttccctcactcagatgtcctctttctaccagccctcctccaccctagatgctcagactcagctttagcatacagcaggcgctaataagtgttgaatgaatgaacaaattaccagaggaaagtgtctggatttgtcttgggggctcctccgggcggatactgactctagcttctttgcccctcctcagctcagagcgcaacacaggcacttcctcggcccgccccccgcctcgccgagctatttgtcgctggtaattgtggcattggagctgggctgtcgggagtgggtgggtgcaggtgctcgggcggcagggtgccagcctcggccacgcctctgccgttcatcctcgactgacgcggagtcggagtcggccggcagaggctcctccagggttccggctggtgggaatctagggaggtccaggagacggggagacaacgaacaagcacgccggccaatcaagaagtgcctgccaggacaagtagccaatcaggaaacccgtaacgcggagctctgcagaggaacgtgccgggcggccctgaggctctaagggggctgcgcagggcccagacattggggttatggcagcggcggggagaggctgggactgcacactcgctttcactcctgccaacctgcgaccacagtggaaaatactgttttccgcaacaggctgctgtgtcttggcccgtgctgtgctgtttgccctatgagatgctatcaccctacttttggggaaggggataggttgtttttcctcctttaaggaatcgtagacgaactcgaagaggctagtttattgaggtttggaaggtcagggggctcagagtggaggagagaagtgttagagttcctcttcctcagggtctttgcaagcaggcacgtgtagacatggtcgtttctcctccaccaccagcttctgcccttgtagctcctcacaccgtggcagcggtctcccccagaaggtcacgttcttctcgccctgaccttcgaccatggaaacggtgggcctgaggcattaggggtggggaggaacggaagggagaatctcagggaaggcaagaatgcattcaattcttattgagtgcctgctatatgccgagggctactttttttttttttttttttccttttttttttttgaggcagggtctcactctgttgcccaggctgcagtgcagtggcacaatcatagctcactgcagcctcaatctcctgggctcaagtgatgctcctgcctcagcctcccaaagtgttgctgggattacaggcgtgagccactgtgcctggcctcccaacactactttttagctataggatattgggcaatttctttagcttctctgtgcctcggtttccctcatctgcaaaatgagaatggtaggaatagtaatattaatactcacctcacggggttgaatgaggataaatgagttaattcaggtaaagtgctcagagcagtgcctggcacacagcaagtgctcaataaatgctggtgaatgttacttgttggcatgagctactttcttttacctccgaaatatataccctttatatctctttccactgcctccaggaaaaaacccaatgccttgtcctgacattcaaggccttattgttgggcccaaatccctgccccaagccaatctctctctctgtctcctccactttattcaagctcagtccctgtccagaaaggtctttacctgggttatttgtcccactaggaaagccctccattcactcccatcccagttctctcaattgcttcttcctccactcagtctctcgctcactcaagtcctttgtgcctccattcaacacctctaatcttcaggccccactctaaccccctcagccgggagatcccttcccagatggcagcccttccacgagctgggaatagttcacttaatctagtagcttgatgtatgtggaaggaagaaaagggatgaacattttaaccctctctaacacctgggcccctctggcacctggaaacacttatagcggctaatcacctagctccaaggctccgttcacagtcttgatgccaggaatgcctttcccaacccctacctgccctgggaggcccagtcagcttcctggacctaggttgaggtggcagcacctgttgcatgcaccagctgttcctcatatgcctcctgtcaggggcttgctcagctgggtcccttggaggatccacaggatctgggctgtgtgtatctgcaactgttgctgaaaaagccttggagtgccttggctcagtgagatgctgacaaagtggatggaggcatgagtgactgtgggaggcaggcagtgaatggaggcctgagtgatggcagctaaaagcatgggtaactgaaggtcggagtcaatgacacatgaaggactaagtggatgagtgactgaacaggtgactgaggggcacagaggctacgaattatcctccaagaacttctttctcatcttcttagtttctccccacttcctgcagctgggaggtggcactcggcaaggcagataccttagattcagcagtggaaaccctggtttcctggggtagccgactctcccgcctgtaatataatgaccccctcccaggcatactttgccctctcactcacgggtacttggggagcaagggtgtgcagaggcgctggcgggcacgggtaggattaggtccacaggggggcatgcacagcccccaggtactccactctgaccatgatcctttcactgcaatgaggggtaggggtcacagagtcagaactggaggtcttggtgggaaagtgagagggaggctgcagagacgtgaggtccacagcagagagttggaaaccccttatcctgcatgggccaccccaccctcagagcacagtctgtgggacactcacaggggcagtgctggatgctgtagcagtgccggatatcctgctgttgcccggcacatcgatgtccgtcaaacttgcggcccctgcaggtcctcccgcgtgactgctggcccgggatttcttgacagctgatggacttcatgttccgtcggatacaggggctccactccccccacgagtcccactccccatccactgcagagacagggcaacaggggattggaccaaagcagggaatcagcaagggggttcagaggaaggaatgagggcggtaggagggagtagaggtgatcagatgtgtgaatgggggaccaggggtggaaacaaggtatcagggccaggaaaggaggaatcagagacaggaacaaggcctcagcagcaggagctgggcagcagagaagggcaagggggacttaggcatgcaaatcgtgaaccctgagatgctgaccagggcagggcacagctgtgttgcagatgtgggtccgggtggcatcgccagcacagaaggggcccccatgctggggcacagggtgattgcacgtccgttgttccatggtctggcccaggccacaggtcacagggcaggggctcacagggccccaaggcccccagcccccagccactgttggaggaggaaagggagtgaggagaaaggcctcctcaatccttcctctcagcccctagacccttgaagcagactgtccccaaatgaagggctgcatggtcacatggcctaggaactctagaaatggcagagcatctctgccctcaatcaagagccccaccagcaacatcagcagcctcatcctggtgtacctgggcagggtggcaggccggtgcacctccgctgctcgtaggctagccccgggcagggcttcccaggaggtttctgggagggctcaggtgcagaacacttgcggcttcgtgtctccttaggttcgtggggtccaccgtggcaggaggctgagcagggggtccaggggccccaggtggcccaggccccgtgtgctgtggtggggtgggaggtggagggatgcaggtgtggtcatgcatgctaaagtcctctcagcctggcagttccctgctgtaaccccgcagacccacgctgggtgcacccatcagcatcctgtggcttccctcactcactggggcagacctgctgggtgtcacaggcctctgattcctgtgcctgtcctgggcagtggcccccacacttgggagcagggtgattacaggctcgcctgcgggtccgggtccctttggagcaggtgacagagcaaggctcccagggcccccagccagaccagccgcccatctctgtgggagagaagagagggtaatgggatggaggtggggtgtcattcagggctctttgcttccttgagtgccccacatgagctaatcctgtccttatatcctctgccaccattctgggcccaccatccccgctcaccgggcctgccgcagcaaccttcacatgggtgcctccgcttcccctctcaccctcaccgtgcacagtctgttctcctcccaaccccagtcagatcacgttcctcctctgcccacagtccaaattactcagatgaaaagccaacgtcctctctgtggcccccaggcaatggaccctcctcacctctctgacctcacctcccaccactctcctccttaggtccttacaaacactggggacgggcccactctgaggacctctgtaccgatcgttcccaccagtgctgggtgacagggagtgcttgcccgccttgctcatcctcctcaccaggacagcactgctggtcctcacaggcctggagctgccactccagggtcccaggtgccacctttccagagcactgcccattccagcccacacagcgccggtaccgcagctgggagccctcagagcacgtcaccgaacagggggcccatgtggaccacagggaccatcgtggggacctgtggagaagagcacacacatcccatcctggcatgagctaacaagaatggcatgtgggactccagagtgtgggcagacacgaagggttgctaggcaagtgcgtgtgcgatggattgataagtccttaccttttagggatattgggatactgatgggaagcagtggatatacaataagtgcttgataatgtcatttaccttcacaatcaggcatctggagttaccattggaaggctgcatggccaacaccaggtccgcagtaagcaaaggtaaggactagaaaccaagggctgctgtcagaaacccaccagatcaccacactacacggtagtaggtaaatagaaagtgcttaataaacctgagccatcatccctatgacctcagaggcctcctcagaaataaccccagatctatccccaacccactgcatagccctaggtatgctgttcatgccaaatagatgtgatgaactgttgacatgacttggggcccagagctgccctcaaaaatccccaagctccccatgcccacggtgtatctgggatatatagtaaacaagtagaaaacaggtctggcatacggtaagggctcaatccatgcaagctggaaatcatgatcaggagactagagctaccctcagaaatcctcaagctcatctcccaaccctgccatgcagctggtatacagggagtgctcaatgaatgtgaagtgtcatcataattaggggcctagagctgccctttgaattccccaaactttcccgcccccacagtgtgtccatatacagtaagcactcaataaacatgagctgtcatcaaaattagggaaataccaagctgcaccccacctgcaatgcttccagtgtgcaggaggtgctcaatatgtgtgagctatgtcagtggttctcaatcaggggtgattttgacccccaggggacatttggcaatgtctgctgacatgtttggttgtcacagctggtggggagaattgctactggcatctagtggaaggctaggggtgttacaaaacatcccacaatacacaggtaagcaatcccctcccccagccaagaatttccagccccaaatgtcaatagtaacaaggttgagaaaccctgaggtatggtcacgatcagggcctcagggccacccttggaagtcccagagaaagaaagtgcccagttttgggtgacccccacagacagtccttccctcccccccatcccccaccccaggctccccctaacctgcaaggctgacagagcccaccactacgtttctggtaggcaaaggcagtgttgagacagcagtcttccacgctgacaccaccccccaggaggcccttgcacttgccggaggattcttcatactgggtgaagcagagcacggggtctgagcctgtaacagggccaggggatgggtgggtggggctcggtcagggatgtggtgggcctggacacccctggggccagctgggccctcaccccctcacctgtggctggcagggtgagcagcaggagcagcggcggcagcaacaatcgaggggcctgcgctccctctgtgatcatgttgagtactgccccctgcacctctaccagagaggaggtcccgctttatctgggttgataggctcctggaatcagcagggaaagaggaacctagaggcaggaggaactgggagggcatcctgctttgaccccaccctgtcccctctgcctccttctctactctcccctccccatttcctgtcttactcttggtcttgttctgtttgttactatatccccagcacctcgcgctcctcccagcaacctcacagtgttcaatagaagctcctaggacaaattctcacccagaggaaatggagcataggagcgtgcagcaacttcctagccgtgtgaccttgggtgagtcacttaacacccctgagcctcagtttccctatgtggaaaatgcataatctctaacataatgacggggtcaacctcgtgggggtgttgaaccagggtgaagtgagtgtgcggtgctcagtatgttcctgctcgtgggggtggagggagcatcgagtcagttgctccaccttccaccctcccttaacctcggccctcctttcctgagaggttccctgtggtcagcttgtggtcggggaggtcagcacaagggaagtgagaaagggaagtggcaggagcctggggagggattcaggaggggaatggggtctatccattgttccatgggcccagctggggacaacaccagggtctggggtgattaggagggaataagctgggccatattccatcagagaaccctcaggcagataacaccccccttctggagcctgtttcccctctgtaaaatgtgctcacagacagcacctacaacataggtagggtgtgttgcaaagattgcgagttaagcttttgtttgttttgtcgagatggagtctcactccgtcgcccaggctggcgtgcagtgtcacgatctcggctcactgcaacctctgcctcccgatttcaaccaattctcctgcctcagcctcctgagtagctgggattacagccgtgtaccaccatgtccagctaatttttgtatttttagtggagacagggtttcaccatgttggccaggctggtctcgaactcctgacctcaggttatccacctgccttggcctcccaaagtgctaggattacaggcgtgagtcaccgtgcccggccaggagttaagcttttggaaagtctttagaacagtgcctggcatatagtaggtgctctgtgtttgataaatttattcaacatttattgagcacctactggatgccagatgcggttcttagcattagagcagagaataggacagacaaaaatcctggccctcgagaagatggataacaaatgttgcccctcctcacagaggccttccccatacccttgtctggcatccctgtcactctctagcccagtagcttccaaacctgtttttttgtttgttttgttttaaagagacagagtcttgctgtcacctgggctggagtgcagtggtctgatcatagctcattgcagcctcaaactcctgggctcaagtgattttcccaccttagcgtccccaagtagctgggactacaggcacacaccaccacacaactaatgtttttattttctgtatagatggggtctcgttgtgttgcccaggctggtctcaaactcctggcttcaatattttctcccaacctcagcctcccaaagtgctgggattacaggcatgagccatcacaccagcccttcttttttttttatttttttattttttttttataaaccctaatgaaactccagggcccactttaaaatttttattttgcttttaattaacaaaaagaagcacaagaaagataggaaggcaatgcctaatttcctctgctctcagggaggcagaggaattctgcaaattcaaatgtaataatttggtcagctgttaaaacagaagttcttcaggaacacttgttttatgggcagtaaagtatgtgttaatatctgtatccattacagacatactctgttctctgataacataaggctatccttgaaaatgtgctttgaacaaaggagtcttattaagattctacgacttcaagacaatcattgctgtgttatcctgtgaaaacactctccaagagacctgaaactggccaggcatggtggctcacgcctgtaatcccaacactttgggagattgaggcaggtggatcacctgacgtcaggagttcgagaccagcctggtcaacatggtgaaacgccgtctctactaaaaatacaaaaattagccaggcgtggtggcggatgcctgtaatcccagctacttgggaggctgaggcaggagaatcgcttgaactcgggaggcagaggctctagtgagctgagatcgtgccactgcactccagcctgggcgacagagtgagactctgtcccaaaaaaaaaaaaaaaaaaaaagaaagaaacctgaaattctggctggcttctttatttaaccacctgttgccctggtaataatattaacaatatttcctttgtttctaaactgtataaatactcataggattccctgtggaagaggactgtcagcactctatcttttcccacacgtttaggcaataaaatgactgcagattccttaaacaaagagtgagagtcttgtcttatttaattattacatccctacctgctactatgtatttgcctgcttcttgttattctcactccctaaatatcagttccacaagggcagggatttttgtctggcttgttaactgctgggtctgcagggcattagataggcaccaggaaacagtggatgctcaataaacatctgctaaatgaatcaatcaatgaaataaacaaaactttagagattacgataaaatgccagaaggacagtctgagttagaggtaaaaatgtgggcatcccatggaggataagtagtatttcaagtgtgaagacctggataagatgacctagagaggatgcgtgagaagagagaagggaatcccagggctttgccctggggaaccccagcatttcaagttttagagaagtaggagaagccagcccagcggactgagcaggaggggcctgtggaggaacaggaaaaacagaagagggtttttctccagggcctggaacattcgagggtctgcagggcattagacctctcacacagtctcatttggtctgttattttctctctctctctttttttttttaaacctatctacacagttatgtttttcttttctttcttttcttttcgagacagggtctggttctgttacccaggctggagtgcagtggcgtgatcgcagactacagcctcaacctcctgggctcaaaccatcctcccacctcagcctcccgagtaactgggactacaggcacacgccacacctggctaattttttaaactatttggagagacagggttttgccacattgcccaggctggtctcaaactcaaactcctgggctgaagcgatcctcccaactcagtgtcctcagtagctgggactacaggcatgcaccactatacctgggtaattttgttttttgttttggtagcggcagggtccttctatgttgcccaggttggtctcaaactcaaaatcctggcctcaagtagtcctcccacatcagcctcccatgtagctgggattacaggtgcacaacactacgttatgctaattttttaaatttttagtagtgacggggtctcaccatgtggcccaggctggtctcaagctcctggcctcaagtgatcctcccaccttggcctcccaaagtgctgggattacaagcatgagccaccgcacccagtccggatttacagcctctactatattctcttaatcacacagcctctcagacattctgtcactcatagtcattttctgtgtcatggattccagccttactacagtctcctaacagtttcacacacacaatcatgtttaacagcctgtctcattcagtcaatattgccaatagtttctctcaccagtcagttccttacatacacgtgcagtcacacaatctcatgaaacgtttaggcactcatttggcctgttactttctcacatacacaaatagtcactgatttatagtcaccactaactagtctctcatgaagtttcccacacatgcacaaaaatcacctctcctacccctttctcactcaagccactttttcacacacccacgatccctgattacagcctctcccacaaagacattcacacgcatacacaatcacacagtatctcagacactgtcgtcacctagtctcacgtttcttctcaatcagcttccagtaccctcagtccttgatttacagcctttcataaagtctcttgcaaagggtttacccatggacacacaatccgtttctcagccactgtctcagtcatcactgtccctcagtcagcttctgatatactcggtcagtatttcacaatcaccactaggccctcgataagtcacccacagtcacccatgccctctcagtcgtgcacaccgtcattttcttcatatggtcagctcatcacggacacacgtgcacagctttacaagtttctcacacactgtcacgtggtcacttggcatgtctcatttgctcagctcttttgtatggcccctgatttatggtttcttatgaactgtttcacagaccccctggtgctctgacatcactcagttgtcaagttcctctcccacagtttctgacttccagttactgctactgccaagtctctcataaacagttccttgtccctctcccttgcatgcccagtgatgtggtctctcacaccatgtcagtggctccgtccggctcaccgtcattttctctcctactttctcacagtccctgaacctgtgggatagactgtggtagtaatggtaaatcgatttgcaactagtttcaggtgtacacacacacacacacagcctgtcacactctcccagtcacagccattcgtttttctcagtctttgctgcagtctctcacgcctgctttcgtacacacaattgcaccttcttgtatctttggtctcggtcactggtttggtctcccagccattctctcccgtacaatcaagttcgcacccatacagtcttacagctttagctgacactacagcctcaagtaaacagttttgcacatcatctatttctcaaacgttgagtcgcctacagtgaggtttgtcacctacacaatctttgccacaatccctgacaacctctactgtagtttcatgcccacgtagtctctcacatgtggttttggtcacccagtctgtcttgctcgccatcaaacagtgacagggctgcagtccccgttcccttctcgtagacattattttgtgcataccatcacaggttcttgtacagtaccttgactattcatccaggctcagttattttctgaaacacagccacaatttcccacatagacacaccatcaaaagtctgtggtcacaacttctgcacactctcacacacaatcacagctttccacgtctctgacacacacatggttaccgatatgcagtccctactattgtttctcacacacgccatcacaccgtttctctcacaatcgacctctgcctcacaccctccacacacagtcatgcgtgtcacgctcagctagtcctgacaacatcagagaaaaagtgccagcagcctccagcatcactttgaaaaatatatatttacaggaacaattccccattctctgggactctttagaaaaaaaaaaggtccattttggggaagtaaaacaaacagtggagacgagtgtagcactgtcccccaaatcaccaacccccaggtcccaaggcctgggctgggccagcgctaacaggtgagcccaggagtcttttgaacccactctctcttgcctagaatagagacaggacaggctttatgtcccccattcctccctcccaactccagggacattgaaagggtcctttgtacccgcccgcaggaaattggggggctgggagggagggaactgaaaattcatgtttggtatcaaaaataaacacttggagtgggggaggcggcaggaagattcccccccaaatcccttccttcccacccaccccaccaaatataggaagagatgactccctctcccctattgaaaagccccatttaaaaatagattatactatcaaaatggcagcgggggagagacagggagacctggagtactggctggaggggccccccagacggggaccaccccccaaaaaaaccctccattgggaggaaacaggcaggaccccagggaggttggcagacaaaggaatggcttctcagggggaagaacaaaagggacattcctccctggccaaaaagttggttgaaaaggataagctgtctgagagaaaggttggggaggtggaaatttctattccaagggtgtgattcttccttggccaagactcccaacccattaaatggtacaaattcttcctggacccctgagtatggccaggaataataaaacaaaacaaactaactcttctactcacatccaaaaacgcagacagggctccctcatctccccaagggcaggctgagaaataaagaaagaaaggtcgttctcaagccagacctcgattgtcttgtcttggggaaaaaagtggggaggtgggggagatgtcctaaccaccctaaaaggttaggtcaggctcctcccagtggccttcaaaaaataaataaataaaccgcccctaccattgaagtaggagacgtgtaagggcggccactgggggactgacagaaaacagagaagttgtggaagctgtgtgttttctgtggaggagataatgagagttactcttgggagtaattcttcccaaggatccccaccccaccacaatcagagcatgagtctttcagttgaactatgtttctccttgagatggctggctggagagagcatggatggagtgaccccagaaggggtggtggtggtggtggtagtagtcatggcttctggggccctggggagagcaccacgggggtcgagaggccatccacgctgatagaagggatgtgcacctgggcgctgccactggatggaaactgggggcaaaaagagggagaggtcacagatgggggccattcttgggtctctcaccctgtccaaaacggggaaagaggatcctacctggaaggagagcttggccgggctacggggcgcaatgggactcagggtgctccagaagtgaatgctaggaggcagcgagctgggtgtcagcagcaccggggtctgtggggagagggtggtcggagctcaagtgagtagaaagtagatgtgggatgctggaagggacttggtcccggccccaccacagatttcccactcacactcccagggtcactccccaaagtgcacacacctagatggtaaccatggaggccatgcctatgatctctcaaactctgcagacaccccccactccccactcccgagagcccaccctcagttgctgagacctcattggtcaagaccacccacaagaccctatccaaatgctgctctcaaacctctcaagtcaccatcccaacagctcagggtcaacttccaactcatgtcccacccatgaaaccccatatgcacatcccagaccaaaaagccctgctcaggttccttaagccacaccccaacctagaaacagtcccacagaaagaccctcggtcccacccacaaaagtccccagccctgcccttcactaatcaaaccccatccctccagccagcatcagcccagtcaatcacactcaaaggctccaccctcttcaggaacaaccacactcaccctcctctgattcctgtcagtcacccgccacatgccaatcccattggtgctggcgcccacacaccccacccctccgcaggcactcaccaatgtatgcgtaggaagcagggatggggtcagcgccggccccggagcctggaggccggagccacttcccgatcctggggtccgttcgggtcccggcccacctagcaggctcgggctgagtggaagctctaggtcccggggcttccggcccttctgcggctgggagatctcagggctggaagccgcatggccgcccgcctgccctgcggtgtccataacaaccgcgggcagccgggctggcacgccctcctgtggagggacttctggctcggccttggtggtttctggcacaaaccctctctcccccgcaacttccaactcttccttgggcccttctactttcacttctgggggcaaagcccggcccaaacccggctccacattaagctcttccgatttcaggtttggggcctcgggcggggtcaggatgacctggtagaggagcaggcacaaagagggtgtgtaaggattgttgggaccacaggattctcctgtgggccacccagtgatttccccgggaaggtggcacttggtactcagggcatgactgcacatcagagcaagtcctccaacaggacataggacttcgtcaaggaagtagggcttcctctggggcaggtcctcctatgggacaggggacttggggtgagacaacctgaagcgggtaggaatctgagggataccatcctcattcattaaaacagtggttctcaaaaatttaccttcctctggaccagcaatatctgcctcatttggtaacaagttaaaaatgcaaattattgggcccctccccagccccacaaattcagaaactctgggggtgtgcctggcaatctgtggtttaacaagacctacaggtgattctgatgagcactagagtgcgagaaccagtgcattaaacatattccaggcacctacatgttcggcagctactaactgtagcacagtattctcccctttctgtctcaggatttgtgtagctctctgccccacccctccttctaagaggatgtcttccttccaccattatctcctttaacgggacagctatgtctcttctaccagcctccctcgtcatccggggattacacatccctcctctttactgcctcctcttactgaatttctatattccagtccttacctgcagaggcaagccggcctcttcagcctccagacaggcctccaaggggcttggactggtgctcctgctccccgaggggggcgctgctgcccctgcaggagctgcactggggagcaccacagcaggccgaggatgagggggtggctgcggctgcagagactggatggtgaaggtggaatagaggcccgagcgcatgtactcgttccggctgctgcgtgccaaaccgcctgggcctgccattcctgcacccttgggtgtgcctggctttccagagacagtgtcccctggggcggcatgtatagcagcaggggccacatttggcatggtggaggtaacagacacctctggctggggcgggcagtcctcagtggagcaccctgcgacctcagggtaggacacaaacttgtagacgaacttctggccgctcaccttgcggatgatgttctaggaagggaggagaggaacagagggccttagaggaaaggggcaggctggaggcagggtgtcaggggggaggaggggggtggagtggcatttctcttctcctagtggctttcttcccacttgctcctctccggctttcccgtccctcctctgtaagtttctctctcagcccatttcctctcccattggtttctacctctttcctctcccgccagattccccttatctatatccctccccagttcctcccctttctctcttctctccacaataattttttctttaagccccttcccatccacccctttccaagcctccctttgtcactctccaggtccgtctatctgattttcccactccctccacactgtagctcctcttcacaatggggcccatgaagggcagtaggtgtgggagcaggtcttcttcctggctccaagaaccagaggttcacagggccaggccttgtgggtgactgtcaggacacagttttggagactagcaaatgcaataagacaagaaaatgaagtaactgatataaatgttggaagaaagtaaattaatgtagatggatggggtgatgaattattaatacagaggattatttgaagctaatgatacagaagtggaacagggcaaggtcactgcagaggagagggtgaggaggcctcattattaataccactgtggaggttgaagctaaaatggtaagaaaatgaagtaactaacagcaattagacaagaatattaaaaatactggtataaatattgggagggggcctatatcaaggctggctttgctgggtcacagagcatgtttggggtttttcaggtctggtgggtctcagagatgacctagtgttcccagagggcagagtgagatagcctcattactaatattgttctggagggttgagctcaaggaataaaatatgaaaatggaataaatgccataaactatgaagggtgtgcagcatatgaccagggcagttctgggagtgtggaggcactagggcattctgtggaagtcttagtgctggtcagatatgtcacagggtgggcctgtgtttctcggaagaggaataaaaagggatattcatgaatattgtttgggaaatttcagtagaaggattaagaaaatgaaataactggtataaatattggggggaggagaaacccagcagtggcctgggggtctgagagggcaggatgggggaaattttaaattttagctgtaggaataagataatgaaaacaattgatataaatattggggtagaccagtgctcctctgggaatttaagaagacagtgtgtggaagttggcattaaacatgttgtttcagaggttttagcttaaggaataagagaagaaaataattagttaaaaatgttgggagtcccagaggacgaagtaagcaaaagttggtataatactgtcagggaggttttgattctaggaatatgaaatattctggaataagagaagactatgaaataactagggaagcccagcactggtccaggggtttcagaggacagaatgaggaccagccattattaaccgtgttttcaagatgttggctataggaatacggcaggaaaatgaaacgttgtgcatggcagggcagcatcactttggggatctcagagtgggagtagaaagagtcagtattaataatgcagtggtggttttcgccaaagcagtaagacaagaaagtaggtgagatagtgtttaggggcccaatactggtcttagggtaccaatggatgggttaaaaactgataaattttaacattgctttcaaagtcatagctatggcaattaaaacaaaataaaatctctgatataaatgtcaggggggggttccagccctggtctgagagactgtaccttgtcatagtagtaccgcaaggcccggctgagcttgtcgtaattcatgttggtcttgttcttgcgtagcccccacagccgggccacctcctctgcatccaccagcttgaattcaccaccatcccgtgaagtccaggagatgatgtggccattgccttgctctctcagcagctgcagcagaaactgccacagcgtcacagatgggtccatcgctgggggagtgctcacgccatcccaggggtacctggagagcaaacagctgagttgagaggctgtggacataggaggggcagaggtcagcgggaggaggattcctttttttgtcatcttttctccatctctgtcttcaaaccctaccatcattccctaaaccttcccagactaacttctagctccccagtcttgcttgggatgctccctgtgatgggatacaactcatgggtatcttaggatggtgtgaatgtattttgaatgtgaaacaaatgtgaatctgtgggggtcagagggcagactgtggtaggccaaatgatgccaaccctgctccgcatcctaatcctcggaacctgtatgttatttacactacatagcagaaaggaactttgcagatgaaattaaggttacaaaccctaagacagggagattatttctggattatttgatgaaattcaatctaatcatatgagctctgaaaagcagatgatggagaaagaaaggtagctcagagatgtgatgacagaagaggcaggggagattcaaaatgtgagagggactcaacctgccattgttggctttgaagatggaggaaggaggctcagaatcaaggactgtgggcagcctcttaaagctgggaatggctgtcagctgacagacagtaaggaaacagggacttcagtcctacaatctcaaggaattggattctgccaacaacttgaatgagcaggaaatggattttcccctagagcctccagaaggaacgcaaccctgccaataccttgatttcagctgagaccagtgtgggacttctgacctacagaactgtaagataacaaatgtgttgttttaagcagctaaatttgtgattatttgttacagcaagaatagaaaactagttccatcctcctcatttgaatattatctgtatcttctaccatatcaatgtcaagtttttcaggaggttttttttttgccagacccttgcaaaggctgctcactccacgtggggcttccttctttcgcctagcagtctttcttatctttcaagtcccagcccaaaggtcctttcctttatgaagccgtcctaaaactgaatgaatgcctgatctctctgtcctgttactgtccctgaatgttctcgttctttttttttttttctttttttttgagatggagtctctctctgttgcccaggctggagcgcagtatagtggcacaatcttgactcactgcaacctctgcctcccaggttcaagcgattctcatgcctcagcctcccgcatagctgggattacaggtacccacgaccacgcccggctaatttttgtatttttagtagagacatggtttcaccatgttggccagactggtcttgaactcctgacctcaagtgatccacccacctcccaccttggcttcccaaagtgctaggattacaggtgtgagataccgtgctcggccctgaatattctctttcttgatgacagcaataattaacatctattgagagcttaatacacatcaggcactcttctaagcagagaggcaatatggcctgctggacaactgcccaggcactagggccagattgccagtgtttgaatcctggttctgccacttattagctgtgtgaccctgggcatattctttttctttttttaagaaatggggtctcactatgttgcccaggctgttcttgaactcctgggctcaagcaatcctctctccctggcctcctaaagtgctaggattacaggcatgaggcaccacgcttggctgatattctttaacctctttgtacctcaattttctcatgtgtaaaacagggataatgatatgcccattagtaaaatggggataacaatacctagttcacagagatattgtacagattaaatattatatgcctgaggtgtatgataagctctaaatattagtttctgatttgttcatagtcccttatctgccattccaacatccaaaatgctctaagggcagaaagcttcttttaactcttttggtggcaaaacctgatttgaaatgaaacaaggccctttctggtctttattgaatctcacttattgcgagtgttcatacattttgctgcagaaatatgaacacagccgattacagagcttactaaggggtgttatgtaacatcgtatatgcatcatgttacctttctgaaatgtgaagaaatggaaattctgaaacacatctggccccaggggttttgggtaagggcatgtacacctgtactgttatttttttttttaatgggcattgacttatttatccctgatcatgcctctgagaagtaggtagtcttcctgtcattaacttataaatgaggcagcggaggcacaaatgtctacgtaccttccacaggccacatgtggcaaagccagcatttggagccaggcagtcaggttccagttgactaagcatttcaccattaggctaaacggcccctcacaccgactattccctctcagcatgtccttcaaagaacaggatcctccctgtcaccccattactgctttctttcctgagagcaaactggaaataaacatgagcttcctgttcaattatacaagtcacaaagccatgaagtgtccgattagagagtcctgtcaccagagacctcactgaatttgttttgcaggcaggcttgtttcagaagtccaaagagttcagagtgactcctggtggcaaagacaggcaattttaccagttcttctttcagctgcaacagaacctatcagctgagtgaaaggtgacggtgggcttccagcttcaacagcacacagggctttgtattttgttatttctcccacttgacccctcataagagttctagtaatctgccttgcttagatatgtttacttctttccatctccttcacttagcaagcatttggtgagtgcatactgtgggccaggtgctgcggatacagtcgagaacgcaacagacaacaatccctgctccagaggagctcacatcttagcaggaaaggcagatgagaaaaaaggcaaacatgtacaagagtgcgtcagatggtggtaagggttatgggaaaaaaatcaagcaggggagagctgttacttttacatggagagtcaggggagagtagtcgccaaggaggggacaactgggcagagaccaaaaggaggtgaaggaactgagctcgtgagtatctgagagcagcaagccaggtggaagcggcagccggtgtgaagggcccaaggctggagagtgcctggcaggtgacatggggagaggaggctgacatgggttcgggggagaggagggaggcagcgggagaggagaacagagtgacgggggccagactgagccaggctttttcgggtgctgtcaggatgttgagtgagacaggagccacaagagggttgtgaacagagggatgacaggctgtgactgagatttcaacaggatccccctggcggttgtgagaagaacagactgttggggctgaagaagccactgcggtagatgatggtggtagcagtggggctggcgagaagtagctggggtctggagaaagcctgaacacagaataggacttgctgacagatagcatgcccgggggaggtgagagaagggtccagggtgagtctaggtttgtggcctaatcacccacaaagacagcattgtggtcagctgaggtgggagccttgcaggagagtaagttttgaggggggtcacaccagttttggagatggtcagtttcagaggcctgtcagacatctacgggtatgctatgaatacattttaataatttaaaaatgcaagccaggcatacgatccttaccgtgggctgcacactctttgaatcatttaactcattgaatcctcaaaccaccgttaaagggtggggattatcatttcccccattttccacatgaggcaatggaggtacagagaagtaacctgccccaagtcacacagctggaagttggcagagccggaattcaaaacctaagtggtttggctctagtgagcaatcgccttacaccaccagttctccatgaagagaaacagagaagggtaagatcctagagagtgacaggaatgctgtttttacacagggtgtacaaggagttcttccccaaggaagtgacacctggcctgaaggaggggaggtagcaagccaggctgccctctgtgggggagggccttcaggcggagcgaacggcgtgtacaaaggctctgaggcagccaccctgaactatctaccgttcccgagacagttccaacctctgagggtaagcacgggctgctctccccgcagggagagctcttccctcacttcatggactcaattacacaatcatcgcattccaggaagaattcattcttcctctgcgtgatcaaaggtgccaaataacctgcctgcccttgcaaatctgttcttctttctgagtcttcagccttatgttcctctgcccctgttctggctattctggctcaaggttaccctgagcaagttactcagcctctctttgcttgtttcctcatctgtaaaatggggatattttactctcaaagtcaaatattctcaaaagtacacctaccctccaaggcttctgtgaggattaactgtgtcaattctgtaaaatacttctgtaaaagacttgaggggttgacttttttttttgtttttacaagtagcattgttaggaacttcttttttatacatgtgcctttgtatagtatattccaagcaccatagtgtttaacaatgaatatttactgaaataacactacccaggtgccagaaaatcaaatcactcttagaaacatcttttatgcctgtgcctttaggagagtgtattatgcacaccacagtggttattttttgggttttttttcggagacggggatctcactatgttgcacaggctggcctggaactcctgggctcaagtgatcctcccacctcagcctctgtgcccagctatacaccacagttttgtgaacacattctttcaatgcaacaacacagtccttattcacatatacaactagcactcttagaaacagcttttatacctgtgcctccatagagcatattacatacctcagttttgtgaacatatccttttgaaaaggaggaaaatccttattcatatataaactggcattcttagaaatatctttgacacatgtatctttttgtagtgcattccaggcaccaccgtgtggtaaacatcctttgggggttggtatttgaacagaaaagtgcctctgatgtgtggcagatactccacagatattagctattagctagtgtgtcatccttctccccctgcccctgcaatcctatcctatgtatcacctgcactatctggctcccatcacctgtgtgacctcaccttctacccttccccgcactctgctccagccacactggccgccttgatgttccttgaacatggcaggcaccatcccacctcagggcctctgaactggcacttccttctgcctggtatgctcttcccgtagacattaaggctctctccgtctctaccgtgaggccctaattcaagagtcaccttccctatgcctaagatttcaaccacccccaatactcgattcctacctgccctatttcattatttcttctcagcatttgtctattatg[140 bp omitted]cctgggttcaagcaattctcctgcctcagcctcccaagtaactgggattacaggcgcacgccgccacacccagctaatttttttgtattttagtagagatggggtttcaccgtgatgcccaggctggtcttgaactcctgagctcaggcaatccacccacctcagcctcccaaagtgctaggattactggtgttagccaccgtgcccagcctccccaacttttaataaatgtcagctccacaagcacaaatatttcgccctgtttcgttccttgccatattccagcacctagaagagtgcctggtactcacaaggggctcagtaaaggttggttgcaggaacagtcccaactaattagctctcatatcccttcttcttcctcatgtgacccctacactggtgtctcaaattatctttttcccatttattcatgggataaattcttattgagcatctgctgtttacctggtacattttcagttgctggagacatagcggtgaatgagcagacaaaaactgagtcctcatgggactcacattctaatgaggagagacagacaacaaacaagtaacccacacagtgtgtcagacagtgataaagggcaacgggacaaatcagggacctggcttgagccctgctgggtgtgcagcttcagatggtcagggaggggttgactttttttgtttttacaagtagcattgttaggaacttcttttttatacatgtgcctttgtatagtatattctaagtaccatggtgtgacaatcaacctttaatgaaataacactacccaggtacaacaaaatcaaatcactcttagaaacatcttttacgcctgtgcctttaagagagtgtattacacacaccacagtggttgttttttgggtttttttttttcagaaaaagggatctcgctatattgcccaggctggcctggaactcctgggctcaagctatcctcccacctcagcctcccgagtagctgggactataagtgcacacccctgtgcccagctacacaccacagttttgtgaacacattctttcaatgcaacaacacagtccttattcacatatacaactagcactcttagaaacagcttttatacctatgcctttacagagcatattacgtacctcagtcttgtgaacacatccttttgaaaaggaggaaaacccttactcatatataaactggcattcttagaaacatctttcatacatgtatctttttatactgcattccacacaccacagtgtggtaaacatcctttgggggttggtatttgaacagagtgctgaaaggaaccatgcagagatctgggggtggtgttcaaggcacaaagaacagccaatgcaaaggccctgaggctggcccatgcctgctatgtttgaggagctgtgtggtggaaccagtgtggttggagcacagtaagggggtgggaaggtataggcggtaatgctagaaaggttacttgttttaccattaattcacagttaatatttatttacactggaagggattctagttctgatcccccatttcacaaatgaagaaaaaggcacagagaggaagtggttaaatcactcatctaaggtcacacagctgctgggattggggggtgggtgggtgctgagagaaggtgaggaatgaagactgctctgcaggcagagggaacagcaagaacaaaagcttggaggtgagaactaatttggtttttaaggactgaggcctcacgtggggtgggatgagatctaagaggggagcctcaaaaattatcctgtgtcctgagtacttcctgggccacctttgagtaaggaatttaacctccctatggcccaattccctcactacctatctcatggggttgtggtgaggattaaaggaactcattcatatgaaacactctgcctgatatacggcaggtgctcaataaacgctagctcctattggcattactatcatcactggcgctaatgtattcacttattgtagtgaggcagaacgtctttgtggttacgagtgtgaccaggctgacccactattaagaggtggaggacagggaaggccgtacagtgctccatcacaaggaaaagaggatcagcacgttctcttctgggaagggaaaaaaaaagagaaggaaattgaaagtacacggccgatcttcccccaattacaaagcactggactcacgggagggtatgcgggggactgtgcaagcatacaggggtgtgggggaggaaggccaatgaacagatccactgcaaagggaggggtgatgaggctcatcgtctgaggggaaggggagcagaaaaccttacagactcctgcaccacagtgagaggagagaaaagccatcacacagactgattcaaagcagagagggaaaaggctatggactgagctactgaaaatagggagatgtaaagcactaaactaacccactattaaaaaggagagaaccccaagcgctagagcgacagtctacgaaaaagaggagacagggcaatggactgatagctaaagggacgtgaatccaaacatgaagactgatccactataaaatggtggtggtggtggtggggggggggggtggttttgaaaaaagccatggactgatgcattgggggactggaggaggcaggaatacaaactcaggtagactcactgttaaagagggatgcggaggagtgcggcgccacggattgattcgctacgatgtacaggaagggtggaataaataaggccacggacgggtctcctgaaagttgaggctaggagaaatccaaacactcagatacacctactattaagggggctgaacactgtcacaggctagctccctataagtgggggtgggtggggggcgggtgggggtaggggtagggggaaagcctatggacgagtccaccctaagttggcgtggggaaaaacataagcacgcagaccgatccattatacaacgggagggggaggttaggccacggtcagatccactataagggacgaagggcttgagcaatgccacacgcaggtccaccagccgtggtggtggcggcggggagtcgaacaccagcaggccaccggccaagccacatcctctgcgcgggggcgggaaggatacgtggggtcacggactgggccctccaccctccaggcccagagctcacctgtgtgtagcgtggcggtggcgttggcaatgttggcagctccggggggcgggggctccatacgcggccccaccgccccccaggcctgggttccgaggcggcggtggaggtggtggtggcggtggcggcggcagcacctagaagccgcccctgcgtttccctacagctcacgtgggcccgaggaggaggagcccaatgtcccgccgctcgctgattggccaaagcgctattaatcggccgcaaggcctcgaggggttgggggacgggcccttccctacagagctgtgccgtgattggcgtaaggggaaatgatggaacgctcacggcccctggagtcccgaggaggcgcgttcggccttcacggtgctccacgccgattggctcaaggactgacggactgtgagcaactgaaaaggctcggggcctgtgtcgggggggcgggggtctgcctcacactgattggcttacatgggattgatggaagacagcccccaaggacgggggtgggtggccctgtttttctctgattggcggacgagggacttctagacccctgccaaaacaccaagggggcggtgtcgcacgccatgctgctcagcggaagcagggcttgtatagaaatgggcgtagcagccggcgggagtgggtcggactgggctccgcgtaggcgggcagggcagctctacggttagacaagaccatagagctgggtaaagacgaatttagaacacagcggaggtaggagggcaggatggctgtcaggcacacgaaagagcattgagtggcagaaacgaaatgctttcagagggcagggttgaactgcggccagagttaaaaaggggaggaacctggctctgcattgattggcggtggctggactcaacctagaataggggcccgactagggagagcgggatccaggtctgtgcccattggaagctggaacacttacaagcaggggctaagacaaggtagggctgagttagggtttgggtgtaatttggggtacctggggaatgattgggtgtgtgaaagcgtaaaccttagggccctttgattgttgtgggaatgaacaaacctccaccatgaattggcccattctctatggcaattcaaagggtggcgtctaggaaaaggaatggaagaaagggtgaggtggggggcccaggttgccaagatgacagaagagagggcagtgcataaggtcaactggcaaatactgccaggcaacaggctggaggcaggactgctggggcattttggaggttccacagagagactggatctctgggtctctcagtaactttgtgccctaggaacaggcccccgtggcaactagcagggtttatggggaaaaagaagggccatgtgactcaaaggcattcaggctctttaatgtctgaggatggggggaagaagtcaatggtgaggcttctctgggaaattctgcaggccttgtagttctctaagcccctgaaaaagaggacagaagagattgaacaaagactgggtctgggttacgcccccaggcttgctctgacctccctcccttgactccagtttagagggaaagatggtccttcccttctttcgctctcttccttcttcaggtcaccaccctaaacacagagtctggtagtggggtgagctgctctcacctctagcaacatgtggatatgggctttgatattcatggagtccttggtgaggctgttgctgagcctagagaaaagaaacaagaaagggcaaaatgggccccacatgattatgatgacccttccttatcacttcaagatctacttatatcctggatgatttccacctggctcattcctatgtggaaatgccaagccaccatctggttttcactgattcaaagattattaaatgcctactgtatgccaggcaattttaggcactgggagatagcagcaaacacaacaaacaaaactcccggcctgatggacttcaaattcttgtaaagaaagacataacaaaaaaccaatggaataaaagctatgtgtcagatggttctaactacaataacaaaaattaaaaatgagagacaataaggagtacaggagtggggggctgcaattttaaagagggctcagggatggcttcacggagaagcatttgagtaaagacttaaagacagtgaattttgagtagtgtggctatatggaggatgtgttccacacacaaggggcagcaaacacaaaggcactgaggtgggagtgtgcctggcatgtttgaggtgcagcaaagaggccactctggctggagaagaataagtgaagggggaatgtaagaggtgaggtcagagaggtaatgagggagacaaactgtgtgaagcctacaaggccatggtaaggaccctggctttgaccttaagtgagatgggagccaagggaaggttgcagcagaggaaggaggttgaattacatgaaccagtcagttgactccttttctctaagccagtttggatcagatctcgcccaaaagaatcctaattgatataaagggtcaaggaaggcctttctcaagaatgaagaatgagaaggaatcgaagaatgcctaatggttaagcagtaggaaggccttttccacaaaaaggacaagaggcaacaaagagctgtttgagaagcagtgaggtcagagtgttagaaattgagtggggagggaaagtggcctaagacaaggtccaagagataggaagaggttagatcacacagggtcttaatataataaggaatgtggattttattgtgctgtcaatgtaggagtcagtttgaggggtaaatgaaactaaatactgttggaaaagcagagagcaataagataggatgttaaattggaaaaaaaagtagtatgaacccatgtatataccaatatctcccacatttttatttctagcccagaactctctcctgaacttgactagttttaatgacatcttctaaaaatccacttcagtgtttaataagtgcctcatacttaacaggttccagactaaattcctgaccttcccctccaaatctactcctcccctaacttctccatctcagataatggcaactccatccctccagttgctcagccaaaaacctgggctcctctctctcacacttcacatccagtcagccattcttcttaaaatcatgactgttccattgcaggtaatgcttctgatctccatgatatgctttctccatagcactgtcaacatctgacatactacatcattcatttgtttattgtttgtctcccctgactagaatgtcagctgtatgagggcagattttgtttttttttgtttcctgctctatccccagggaccagaacagtgtgtggcacagaggaggcacccaacgtatgttgaatgaataagtgactactccattaaaaggaacctgaggttggctgagtgtatgtttagggacaggaaataaatgaagtatgggtgttgttgccagagagcaagaatactttcaagaatattctgggggtaatgcttaaagaacagaagaatgaacctgatcagctcctaagggacaattttaacatcaaaaaagagaacaaaattagttaatggtgtaagcttaccttatgaaaacctatgagttcaacactttaaaagggagaaaaatacagagttcaccaaatgctagctgtaacacaaaagggatatgtttattactgctgatttatttttatttgctatgtgagaagcaaattactactgatttagtatgtaaggcagtgtgaatagtcatatggttatgcttttttttttttttttgagatggagtctcactgtgtcgcccaggctggagtgcagtggcgtgatctcggctcactgcaacctccaccctccgagttcaagcgattctcctgcctc[211 bp omitted]ctattcatgagatgtggatgtgtactcctttctgtgtcatcaggaaagaatatagagatttcatcccttccacttcccaaacaaagaaatatactaagaacaggaagaactgacacttttgatcacataaaatgaccagaaagttagttcaaagtatatcccaagtaaccaaatatttttaaaggacagccagctacatagactcaaatcttcatctcttagaaaaattaaacttctagacagtcctactaattacaataaagcagtaagactcaaccatatttttcatcacactaacagaccaggtcagtacatcaaaaagaccaggcaagggggcaggcactgacaatttaaatacttcattttggggaagtacgtggagtctcaaaacattaaaatctatttgataggctcaggaatcctgtgacataacaaggaaagccttcttatacaaactagactttagctgggcgcggtagctcacacctgcaatcccagcacttagggaggctgaggtgggcagatcatctgaggtcggagtttgagaccagcctggccaacatggcaaaaccctgtctctactaaaaatacaaaaattagtcgggagtggtggtgggtgcctgtagtcccagctacttgggaggctgaggcaggagaatcccttaagcccaggaggcagaggttgcagtgagccaagatcgcaccactgcactccagcctgggcgacaagagcaaaattccgtctcaaaaacaaagtggacttggtctaaatgaccaccagttcagaattgtgttgaccatgaaagcaggccgtttaattaaactatttgctaattggtctgaacaccaagaatcagaaatctcagcaggtctgaggttcttttgggtccactagcacctgctagtccttcccatggctggaaaggtttgaaaagataaaaattactgaaactctaagggaggcaactctggaaaaaatgaatgtagaacagacataaacacaaaacacaaccaacaaagaagtttaaatcaatggtactcacacttgtgagatgttgttaatctaagtgtattgctcagtgcccccatgctcattccattgaaaccaagctcacctctcttggtagtttcactagcataccaggcacactattcctcttgccaggaatgctcttcgccagatagccccatggctttgtcactcagtcaaatgattcaaatgtcccttcctctgggaggccttccctagctacatttcaaatccctcatctatgctcccaactgcccttccctgcacaaaaccgtaaatcaagcttgtccaacctgcaaccagtgggccacatgcggtccaggacggctttgaatgcagcccaacacaaattcataaactttcttaaaacattatgtgatttttttttgcaacttttttattttagctcatcagctatcattagcattagtgtattttatgtatggcccaagacaaatctcccaatgtggcccacggaaaccaaaagattggacactcctgccttaaactcaactggagcccacattttctctccccatcacccccaacacagatctgcttcaataaccactttaatatgcttccagcataccctttcaaattatttcaacaaacacaaagccgggtacagcagtgcgcctgtagtcccagttacttggcaggctgaagcaaggggattgcttgagcccaggagtttgaggatgtagtatgctatgatcgcagctgtaaacagtcactgcattccagcctgggcaacacagcgagacaccatctcttaaaaacaaaaacacagagtgtctactatatgcttgtactactctagtcacctgggtataagggaataaaccaaatctccccctttgtaaaacttacattctaattggaggagacaacatgagaaagaaattacatagtaaatattagggggtgataagtgttagtagaaaaaaagtagaaggaggggaatcaagcatgccaggggctgtaatttgaaagttaggttacagagggccttgttgaggaagtgacatttaagcaagacgagtgagtgaggagaaaggaagccatgtgggtactgggggaaagagcagtgcaggcagagagaacagctacagcaatatccctggggtgggatcattcttggggtgttgaaagaagcatgtgaaggtgagtgtggcaggaacacagtgaatgaatagtaaaattagcaggaagtgaaatcataggtaactagttttcttgttaccaattctaacaggctgagacctcatggatctggtcataattgtatttatgtataacagtatagtccttctagattgtaagccttcaaggaactcttctgtcttgttcactgctgcattcccactgctaagcacagtgcctggcatacagaagatgcccaataaatgtttgcgtgaatgaacaatacaaagatcattttttgagtgcttattatgtgctacacatgggctttgcaaccccatttcttcagccccagctctgaagaggaggggagatgagtccttaagtatcattccaggcagccatgggtaaagggagaagagtgttggaaatggtggtgtttttacacactatcctcatggaatggacttactctgtgaggagagagctcttacgatcaatgaacttgagagcttctgccagtgtcaactccaggaaaaaaccatatcccagggccacatagatgcgtgaagtatctgggctgaggaaagagaggttagaggaagtggggagaagtccttatcactgtttagcatagtttatgttttgctccccacccttccccaaattgaggctctgggaaggcagggattttgtcctattttattcactgtcacatccccagcacctagcttatatcctactgggatataaaacctcgcatagtgcctggtacatagaagatactcaaaaaaatataagttgcatgagggaaggggtaagctgaaccctgtgggctcagaggggcgggtagacactcacaccactgtgtcaacgaagaagttacagcccaaatccacctgcatatataactccgagtgcttagcttcctgtggggccagggaaaaagaggtaggggtcagtggtgaactcttaggtcaggtgacagggttgggtctggagtctctcttcccatttccctcccttgcccacacataccaaaaaaatggtacccaatcccatagtctttacctggagtcgctcaatgacatttctcagttgaaggtatttggccagctgctcatataccttgtctcgatggtccagcacctttctgatgggacgaaagtacaatggtgaccaataggcagccccattcctcctagtatacctcatatcatgaccctctgagactctcatgtcaccatacactgaaaaggctttttagtgcataagttaattttcggctctgggtcagactgcctgggtttggatctgggctctatcctttatagatgtgtgactttggcaagtaaataacctgtttgggactcagtttccccatttataaaatacagatgacagtattaccttgtagagtcattaggattaaatgagcgtttactacaaagcatctagaataatgcttatcaaatggtaaactctctatatacatgttagttataattactattattatactcccaatactgaactccaatcataatgtcccatcctcaccctagaaaaatcctccatcccttttaggatgctcataggcctagttctgaacaccttatttcctgcttagattaacaaagattgcaataatatttcttcatactcattgaacctctactatgtttcaggcatccatgctaaattcttgacaaagatgggacacatcaaaaactcaaaaccactgcatggggaaggttccagaaaactccccatttcacagaagagtaaagtttatagggcacagaaaggcgaggtaggacgtattcacaaggatgaagaatggccgagccaggattcgaacccgagaactgtggctccagaaaacaagccttaatctgttaaacatcggaggccgcgcatgcgctgacacgcccctgctatgaacgccacgtcccagccaaactgcaccccggatgtcgtccccacttctcgctccaaggagcgcggggccggactctgaacgcctcgcccgccaattcaaagggttggccctaactttgaacgccccacccaccacgtggaatgttccaaacgccccgccccccgcactgtcactcaccgcaagtcccgctgcagcacgtcactgatgaaggtctcgtagcgcagcactttctcccccgtggcctccaccgcccgccgcttagggggcgtcgccatgatgggctcctggggagtggggagggggaagaccatgttgaccgatccagtttggcctcacacacagttcatctctaccctctcaacgctgggaatcggcttgtccggctcaagctggaggttcagccttccgcccctcccaactcggggacccgaccacccagggacacccaagcgcggcctttacctcaggccgccagcaataagaacggttggtaggaaccgcggcttccgggtggcgcgggtgaatgacgtaagtggcaagcgcgctggccaaccaaatagccagttggggaggggcgggcctgagtggaagaagacgggccaaaggggagaagagaagggcagggcttcacggaatccgaggagatcaaagaagactagggcgtgcgagcaggggccgtctggcaataaaccggccaatgggggactgcaaaagcggcgcctggagcctatggagaccgtgtgtggctggtgggggtgggatttaatgggatttggcgggttctaaggtaggcgcgacgcacaggtggaggtagaggaagtgaagagtttaatatttaaaaggacctaaaaattgactatggttctggtctataaggaagatcccgtgtgatctgtcggcctggatattgatttttcacacgggaggtttggatttcactcctggcaatgggactgagtataagcatttaaaaggttttaaacagagacaggttttctaaaattcatctttgataactccagctctgcactcgcaacccataagtgaggctcaagtggaaattgacaacactctctgtctaatcacctcgtttgatagtcaaatggagagggtggctgaagtcctctgccgaagattggccatcttgtagttaggcatagttcccatgtttttatttaaatggtaaggtttttgtgaatttattcttatgcactagagtgactgagtgaatttatttttcaggttagattttcaaacaagaacttataacccagcaagaatgggcctttgcctggagaagaatccagaccatgggatgaatccccaaatgctatttccatctgtagagcctagagcacccacccctaccaaggaagtcttcccagataatttgtgtttcatatgtaaaagcaagttttttttttcaaatgctcaaaacccaagcaagttaagcccttccttccttccttccttcctttcttttctctctctctctctttctttctctctctctctctttctttcttttttttcttttttagacagggtctgtgtcccctaggctggagtgcagtggtatgatcatgactcattgcagcctcaacctcccaggctcaagtgatcctcccgcttcagcctctggagtacctgggactactggcatacaccaccacgcccatctaatttttaaaaaagtttttgtagagacagagtctcactatgttgcccaggctggtctcaaactcctaggcttaagtgatttgcccacctcggcctcccaaaatgccgagattataggcatgagccagcacacctggccaagttaagcttttctttgcccttagaacgagataattgtaaaatgaaaacattgagattagtttttttggtctgtaaatctcatgttacatatagtttaaattacattgagtgtgattggaatagatactaggtagaaaaatattatctagttaatctataccactttcctgtgaaaagagagaaaagaagacacatatttatttaacagagaacacaattctgatgggctggagatgagtctgtgtaagtctattaacttatatttcacaaaaaagaattttttacttaaaaatgtatttccaactttatttttacatttcaaacctacagaaaagttgacagtgaacactcatataccctgcacttaagttcgccagttgttttattttgaatttttaaaatttttttagaggcagggtcttgctctcttgcctaggctagaatgcagtggtgtgatctcggttcactgcaacctctgccaccgggctcaagcaatcctcccgcctaagcctcctgcatagctgggactacaggcatgagccaccatgcccagctaattttttgtagaaatggggtttcaccatgttgcccaggctggtctcgaatgcctgagctcaatcagttcgcctaactcggcctcccagggtgctgggattacaggcgtgagccaccatgcccggcctggattcactcgttgttaatatttgatcacatttgctttctttccagaccataggataattgttgacatggctgcatagcattccattctttggatggcctcagatttttgagccactcctctgtcactggatatttgaatgtgttcagatattttcgttgttataaccaggatgggataagtctttgctgtcaaatttttgtgcggagccatgattatttccttgtgataaattcctagaagtagaatttatagattttttttgagacagagtctcactttgttgccaaggctggagtgtagtggtgtgatctctgctcatggcaacctctgcctcctggtttcaagtgattcttctgcttcagcctctggagtagctaggactacgggcacacactaccatgccgcctagctaatttttgtatttttaatagacacagggtttcaccatgttggccaggctggtctcgaacttgtggcctcaagtgatctgcccacctcggcctcccagggcgctgggattacaggcatgagccacctcacccggctgaatttatggatttaaaggaggtcactgcattgtaaatcaagtgttgagtgacagtggtacgcataacagtgaacctcctcatctaagctctatatcaggggtcagcaaattatggcccctggtttgctgaccctttacagtttcctatagcctgcaaactaggaatactatttacatctttaaagggctttagaaaagtaaaactaatattttgtgacacatcaaaattatatgaaatttgcattttagtgtccattaataaaattttcttggaacacaagtctcactcatgcgtttacatattgtctgttactgctttcacgctataatggcagagttgagtagttgccaaagagaccacatggtatggacatcctaaagtatttactatctggccttttacagaaaaggtttgccaacccctgctctgtacaatgcctgtcaccaatacagaggttggggctctaaccaggtgggtctccctggcttccactggcgacctcttaacctggcttatgggtgcacattttcaggctggtgcttctgggagatatgagagacacagtcagcttgtttccagctccaagatgtgagatggactgtgtctcttatgtctgcatttgaatcttctctcctttccatccaacttcctgcccccagctctgactcataggtctctgtctttgccttttcccaagaagagcaagaaatgactaaggcccaggggaggctgcatttccctgatagctaatgatgtagaacatcttgccatgtgcttatttgtcatctacatgtcctttatggtgaaatgtctcttcacattctttgctcatttaccaaatggattgcttaaaaaaaaaaaaaacttgagttttgagagttccttacatattctaggtatgagttctttgtcagatatgtggtttgcaaatatttcctcccaggctgtagtttgtctttttgtcctcttaacaaggtctttgttagagcaaacacatttaattttgaagtctagtttattgatttaaaaacattttttggatcatgcttttgttgttgtgtctaagaactcttcacaagccgtagctcccaaagacgttctcctgtgttttatttttaaagttttttaattttatgtttgacatttaaatctgtgatctgtttttaaaaaacagctttattgagatgtaattcacatacaataaaacccacacatttgaagtttacagttcagcagtttttaatatattcacagagttgtacaaacatcaccacaatctaactttatttttttaataatttttttttttttgagacagggtctcacgctgtcacccaggctggagtgcagtggtaggatcttggctcactacagcctcaacctctcaaacgcaagcgatcctccctgcctcaccccctcaagtagctgagactataggcatgtgccaccacgccggctaagttttgtattttttgtagagatggggttccactgtgttacccaggcaggtcttgaactcctgagctcattcgatccacccacctcggcctcccgaagtactgggattacaggcgtgaggcaccacgcccagcaatctagagtattttcatcaccccaaatagaactcctgtacccactcctcagtgtgttctccccaccccagccctaagcaaccacaaatttaatttcatctgtaaaaatttttgtattctgcacatttcaataaatagaatcatatacactatgtggccttttatgcctggcttctttcacttagtataatgtttttaagtttcatttgtccatgttataatacttattagtactttattcctttctagggctgaataatagtcccttgtgcatatatgccacattttgtttatttctcttaccaatttcagtaaaatgtaaagtccttactccttttaagtcccttttcctccccctttataacattaaatgttaaataaatatttcctctctctatattgggaatcatctcaatgttgtaatttatacttcaaccatcaagcaccatttaataaacttgagagggaaaataaagtctatttattgatatttttgctccttttgttgttttcctttctgatgttccaagattccttcttatatcattgcccttctgttgtaaggattttctttagccattctttcaaggtaagtctgctggtaacacattctcttagttttccttcatctgagaatgtcttaatctcaccatcattcctaaggacatttctgccagctaaagaattcttggttggtattccttttatgtcatctcttgaaaactgttgtgccacttccttctggcttccatgttttccaatgagaaattcactgtcattaaaattatttttcttatgtagataagatgtcgtttcctcctgctttcaagaatttttatttgtctttaggccaggcataatggcttgtaatcccagcattttgggaggctgaggtgggcagagcacttgaggtcaggcgctcaagactagactggccaatatggtgaaattcccatctctactaaaaatacaaaaattagctgggcgtggaggcacgtgcctgtaatcccagctactcaggaggctgaggcaggagaatcgctggaacccaggaggcagaggttgcagtgagccgagatcatgcccctgcactccagcctgggcaacagagcaagactctgtctcaagaaaaaaaaagaaaaaaattttctttgactttagttttcagaagtttgactctgatgtgcctcagcatggatttctttacgtttatcctgtttagggtttgcttagccttttgaatctgtattcaacaggtttatatttttagccaaatatggcaaaatttcagacattgtttctttgaatactttttcagctctttcctctttcttctcttttctggactttgataacacaaatgatcgaatatttggttccactagtccctgaggctctattcattggttttcagtctacttttctctgctgtttggagtaatttctattgttctatcttcatgattcgtgattctttcttgtgtcctcttcattctgcctttgaacccattcactgagctttcgattcagttattgtgagacaaagtaccatatgtaagaagctatgtttgctcattcggcttaccagcagaatttcacaaaatcccttatcagtggaattttacaaagcccctgactcagtgactcagcaccacccactggaagaatgttctgaagatgatcagcagtatggaggacagcctgccatgtcccttgtgtgaatcacagcagttttagaaaggataagttcagcgatcctaatcctggcctcttcctatacagaagataacaggattatctgaccggattaataattaggcctctgtagtctataaccagatgtgccctcatacccaagccttgatgtgattttgctctaatgtaacttctgagcacatttgatgtaacttctaagctacatgcagagctgccaccacctgtgtataaactgtggcctaaaacagttggagcagtttaacagaaactctctgaaagactctctccggttgcaatcttcagtaagagttctgaataaaattaacttaggccaggcacagtggctcacacctgtaatcccagcactttgggaggctgaagtgagcggatctcttgagttcagaagttcaagaccagcctaagcaacatggccaaaccccgtctccacaaaaatacaaaaattggccgggtacagtggcgcatacctctagtcccagctactcggaaggctgaggtgggaggatcgcttgagcccaagagatggagtctgtctgcagtgagccgacattgtgccactgcactccagcctaggtgacagagaccctgtctcaaaaaaaataaataaataactttaattctttaaaagcctgatttttttctttagttgacagtatttttcagttctaaaattttcatttggaaattttatgatggcagagccctcatgaactaatcaccttccaaaggccacacctcttaatactgctacattagggattaagttccaatctacgaatattgggagatacattcagactatagcaggccccctccattttctcctgaacatgcatgcagatttgcttatgtgctgtcttccagaccgcttggggtaagtaggatcttatcaaggccttttttgcctgtctcattccctgtatctccctgttaaatttattactgaactgttgatttattacttaaccccagtcagtatgaagacctcagaatgtctctgatattgacctttcctggttgttagccactgagaacactgttgttttattgtttgtttgtttgaagacagagtctgactctgttgcccaggctggagtacagtggtgcaatcttggctcactgcaacctcagcctcccgagttcaagcaattctcgtgcctcagcctcccgagtagctgggattacaggcgtgctcctccacgcctggctaatttttgtatttttagtagagacagcgttttaccatgttggccaagctgatcttgaactcctgacctcaagtgatccacccccacttggcctcctaaagtgctgggattacaggtgtgagccaccatgccccgcctgagatcactgttgtgttgtgttgtgttgttttgttttgttttattttattttgttttgagattaagtctctgtcgcccaggctggagtgcactggcgcaatcttggctcactgcaatctctgcctcccaggctcaagcgattctcctgcctcagcctgagatcactgttgttttaagtgttgctcctgtgcatagaattttcctcactgctctaaataaagtcagccctctcctgcagcagagctgctggttctttgggtctgccctttcttggtggagcttctgtgcctcagagctggaggagatagtaacagctctagattaaaacaccacaggcacctactattcttactgagatctgagcttcagtagattttcttttactttttcctatcagagcttgtcagaacacttaatatgttgatttttaaaaatattttattttttgtgggtacataggtgtatatatttatggggtacatgacatattttgatacaggcatacaatgtataaaaatcacatcagggtaaatggggtatccatcatctcaatcatttagcctttctttgtgtacaaacaatccaattatagtctcagttattttgaaatgcacagtaaattattgttgactatagtcaccctgttgtgctatcaaatactagatcttattcattctatttaattatatttttgtacacattagccatccccacttctcctgcaaccccactacccttcctggcctctgggaaccatcattctattctttatctccatgagtccaatcgcattaatttttagctcccacaaataagtgagaacatgtgaagtgtgtctttttgtgcctggcttatttcactcaatatcttccagttccatccatgttgttgcaaatgacaggatctcattctttttttgtggctgaatagcactccattgtgcatatgtatcacatttcctttatccattcatctgttgacagacacttaggctccttccaaatcttggctattatgaacagtgctacaataaacatgggagtgaagatatctcttcaatatacagattttctttctctctctctctctctttctttttttcttttctttctttcagacagggtctcactctgtcacccaggttggagtgcaatggcttgatcttgtcttgctgcagccttgacctcctaagctcaaacaatcctcccacctcagcttcttgagtagctgggactacaggcatgtgccaccatgcctggctaatttttatatatatatatatataatatatattatatttatataataatttatatatataatatatattatataatatattatatatataatattatataatatatattatatataatatatataatatatacaatatatacaatatatataatttatatatatataatatatatatattatatatatatatattagagatgggtttcatcatgttgcccaggctctatttctgtgaagaatgtcattggtattttgacaggggttgcattgaatctgtagattgctttcggtagtatggtcattttaaccatattgattcttccaatccatgaatatggaatatgtctccattttttgtgtcctcttcaatttctttgtttcacagttttattgtggagatatttcacttctttggcgaagtttattcctaggtattttattttatttgtaggtattgtaaatgggattactttgctgacttctttttcagatggtttgttgttggcatatagaaatgttattgatttttgtatgttgattttgtattctgcaacttgactgaatttgtttattagttctagtagttttttggtgaagtcttttttttgtttaatttaatttatttgccaagatgattagtaaattgcataactaaatttgaagtatacttgagcaagttttctaattccaagtctaataatatttccgttatacatgataacttttgtaaacatacatggcttgatttcagcaagtacaatagagaaattaaaaccataatctactgtttatatgaaatgtctggaacaggcaaacccatagagacagaaattagattaataattgtcagggaatgggaaggaggcagaattgagaagtagctgttagtgactatgggatttctatttgaggtgataaaaaatttctgaagttagataatggtgatagtcacacaactgtttgaatatagtaaaaaaaaaaaaaaaccactgaagccaggtgtggtggctcacgcatgtaatcccagcactttgggagcttgaggtgggaggatcacttgttgcccaggagtttgagatcagcctgggcaacatggtaaaaccccatctctacaaaaaatacaaaaaaattagctaagatcacaccactgcactccagcctgggcaacagagactgtctcaacagaacaaaacaaaacacacaacactaagttgtatactttaaaagggtgaattgtctctcaatacagctattgtgactaccataatcttccaagtttgtcttgattcatttttaaagtataaaatgctgttttttataggttagaaacaaaatatatagcagactgttgtcacttcattctccaaatagttattatggaatcagatcaccacaggagttattcaaagcatcaggattgacacaggtaggaaattgtaatagtctctaatgaactgttctgctcttcattttaagtaaaacttgacttcttctgattatattcctttgatttttacaactactgttcttccattcagactgatcttttgaattatcttttttttctttctttctttattattattataatttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatatgtgtgcatgtgtctttatagcagcatgatttatagtcctttgggtatatacccaataatgggatggctgggtcaaatggtatttctagttctagatccctgaggaatcgccacactgacttccacaatggttgaactagtttacagtcccaccaacagtgtaaaagtgttcctatttctccacatcctctccagcacctgttgttttcctgactttttaatgattgccattctaactggtgtgaaatggtatctcattgtggttttgatttgcatttctctgatggccagtgatggtgagcattttttcatgtgttttttggctgcataagtgtcttcttttgagaagtgtctgttcatgtccttcacccactttttgatggggttgtttgtttttttcttgtaaatttgttggagttcattgtagattctggatattagccctttgtcagatgagtaggttgcaaaaattttctcccattttgtaggttgcctgttcactctgatggtagtttcttttgctgtgcagaagctcttgttttaattagatcccatttatcaattttggcttttgttgccattgcttttggtgttttagacatgaagtccttgcccatgcctacgtcctgaatggtaatgcctaggttttcttctagggtttttatggttttagatctaacgtttaagtctttaatccatcttgaattgatttttgtataaggtgggtgaagtctttaggcttttctaactgtaagatcatattatctgcaaacaaggataatctgactttttcctttccaattcagatgccctttatttctttttcttgtctgattgctctagctaggactcccaggactatgttgaataacagtggtgaaagtgggtatccttgtcttgttccagatcttagaggaaaagctttcagtttttctccattcggtgtgatactagctgtgggtctgccacatatggcttttattatgttgaggtatattccttctatacccaggtttttgaaggtttttgtcatgaagggatgttgaattttatcaaatgctttttagcatcagttgaaatgatcatatggtttttgtcataaccaacaatcgaagtgaaaactaataaaatgctacactttaacttcattccccagcttttaaactttttgttgtttctatttatagcttattatactgtctctatcttgaaaagttgtggtattattatttttgataggttcatcttttagtctttctactcaagatagaagtagtttacatactgctgttacattgttacactattctgtgtttttctgtgtacttattagtaccagtgagttttgcaccttcatgtttgaaggatattgttactgaatatactattctagggtaaaaggtgtttttccttcaacactttaaatatgtcatgccactctctcctggcctgtaaggttttttgtctcctctgactgtatattttcaaatagcctgtcttcaagctcactaattcttttttctgcttgatcaattctgctcttaagtgactctgatgcattcttcagtatgttaattgcatttttcatctccagaatatctgcttgattctttttatttcaatctctttgttaaatttatctgatagaatttcaaattccttccctgggttaccttgaattttgttgagcttcctcaaaacaactattttgaattctctgtctgaaaggtcacatatctctgcctctccaggattggttcctggtgccttatttagttcatttggtgaggacatgttttcctggatggcgttaatgcttgaggatgttcactggtgtctgggcattgaaaagttaggtatttattgtagtctttgcagcctggacttgtttatacctgtcctttttgggaaggctttccaagtattcgaaggaacttgggttttgtgatctaagtctttggccactgcagtcatatctgcattagagagcaccctgagctcagtaatgctgtgacttttgcagaatggtagaggtacctctttggtgatcttgggtaagatccaagataattccctgtattgccaggcagagacttgctctcttcctttagttttccccaaacaaatgaagtctctctgtctgtgctgagctgcctgtagctgggggaggggtgatacaagcacctctgtgtttacaacaactaggacttcgctgggtcagacccaaagccagcacagcactgggtcttgcccaaggtccatggtgtccattgcctgggtaccgcctatgttcactcaaggcccaaggactctacagtcagcaggtggtgaatccagctaggcttgtgtatttccttctgggcggtgagttcccccaggccccaggcaggttcagagatgccatccaggagccatggcctggagtcaggaaccttaggattcgacctagtgctctattctactgtggtggagccgacacccaagttgtaagactaagtccttcctactcatgcttcccctttcttcaagcaaggacatgtctccctgtggctaccaccactctaggcttgcagaaggtactgcctggctactgttgatgttcattcgaggcccaagggcttgtcagtcagcttgtggtgaatgctgccagtcctgagtctcttccttcagggcagtgggctcccctctggcccagggcaggtcaaggagccaaggcctggaatcggggaccccaggaacctagttggtgctctaccccactgtggctaagctggtacccaagctgcaagacaaagtccccttcactcttctctctcctttcctcaagcagaaggagtcgctccccatagccaccacaactgggaatgtgctgggtcacacctgatgccaacatggctctgaatctcatccaacgcccatggtgagtagtgcctggctatcacctctaagtattcagggcctaatgactctttagtcagtaggtgatgactcctgccaggactggatccttcccttcaaggcagcaggttcctttctggcctagggtgtgtctaaagtgcctgggagctagggcctggaatgggggcctcagaattctgcctgataccctattctactgtggctgagctggtatccaagttgcaagacaaagtccctttaactcttcactctcctctccccaagcagagggtaagagtctctcccagagctccaagctatgctgcctggggttaggagaggggtgacacaagcactcccttggccaccccagctgctgtctcactaggtcacatgcaccccaagtccattggctctaagctcagcacagcaccaggacttgcctaggaattgcagtccttgtggcctagactgcctttcaagtttatttaaaaccccagagtttttatttatattttttattttgctttaagttccaagatgcacatgcagaatgtgcaggtttgttacacaggtatacatgtgccatggtggtttgctgcacctattgacctgtcatctaagttccctccccttgtcccctaccccctgacaggccctggtgtgtgatgttcccctccttgtgtccatgtgttctcattgtttaactcccacttatgagtgagaacatgcagtgtttggttttctgttcctgtgtcagtttgctgaggatgatggcttccagcttcaaccatgtccctgcaaaagacatgatttcattcctttttatggctgcatagtattccatggtgtatatgtaccacatttcctttatccagtctatcattgatgggcatttgggttggttccatgacttggctattgtgaatagtgctgcaataaacatatgcatgcatgtgtctttatagtagaatgatttatattcctttgggtatatacccagtaatgagactgctgggtcaaatggtatttcttgttctagatccttgaggaatcaccatactgtcttccacaatggttgaactaatttatattcccaccaacagtgtaaaataaaaccacacatctacaaccatctgatctttgacaaacctgacaaaaacaagcaatggggaaaggatctcctatttgataaatggtgctgggaaaactgcctagccatatgtagaaaactgaaactaggcctcttccttacactttatacaaaaattaactcaagatggattaaagacttaaatgtaaaaccccaaaccataaaaaccctagaagaaaacctaggcaataccattcaggacataggcatgggcaaagacttcatgactaaaacaccaaaagcaatggcaacaaaagcaaagaaatgggatctaattaaactaaagagcttctgcacagcaaaagaaactatcatcagagtgaacaggtaacctacagaatgggagaaaatttttgcaatccacccacgtgacaatggtctaatatccagaatttacaaggaacttaaacaaatttacaagaaaaaacaaataaccccatcaaaaagtgggcaaaggatatgaacagacacttctcaaaagaagacatttacgtggccaacaaaaatatgaaaaaaagctccatatcaatgatcattagagaaatgcaaatcaaaaccataatgagatgccatctcacgccagtcagaatggtgattactaaaaagtcaagaaacaatagatgctggtgaggctgtggagaaataggaacctcagagtattttagccagtgatggcagagcttgctggaactcaggttttgattgctgggatggatgtcatctggttagggctcatctaaatgctccctccatagacgccagctgagttctgccccatgttgcttttcgctgtgacacggcagcactgagttccaatgcaaagtcccacattcactgtgttctcccttcctcaagcacacagattctctctctgcaccacatggccactgccagatggtgagggaagggtagtgtaggtgattcaagactgtctttcctaccttctttagtgcctctttccttaaaataatattaaaaccaagtactgtgactgcttacctgctttttggttcttatgaaggtggttttctgtgtgtgtagttgttcaatttggtgttcctgtcgggggacaatcagtggaagcttctatttggccatcttgctctgcttccaagcctcagtagtttttcttgaataaccacttcccaatttgttatattaccttggtaaatttccagagtctttaactggttgtttttggcaattttgtccacttttgtcatggcgttttgtggagaggattgccaagctccttagtcaacctttccagatgtctctcccttccttgtaactagagttttgattgcatcacttaaaaagtgttagtatgtttcacaaaaatgtgtaccagtatgaattagcagtatatttatttatttatttgtttgtttattttttaagacggagtcttgctctgttgctcaggctggagtgcagtggcgcaatctcggcttactgcaacctccgcctccctggttcaagccattctcctgcctcagcctcccaagtagctaggattacaggcatgcaccaccacgcctgggcaatttttgtatttttagtagagatggggttttgccata[136 bp omitted]ttagcaaagtgtaagggttctttatgtgtactttttgtgccatatctgagaaaccattaaggggcaggatttgaatacatatctggctccagcattcatgttcttaaccattacaccacgctgcctgtcttgaattagcagtttagatataaatgatttatgtatgtcgtgacttagactcttgatttattccaaacatgcttagtcaccatgcagtatctgtattttcacatgtgtatttgtatatatgtgatgattgtgacacataagaatggttattgcattattcccaacaatagaagataatggtttgaagcagcaataagtgagtactattattgctctccctattaatggtgcccttatttcagtgatgacgttctctgtcttttttgcctatcacttttgtttaatattctttcctcacttctagaaaaaaatgtgtttcttctttaatatctgatatggttaatgacagagcaggagcaccgtcatcttggacaaacaccgccactctaagttcaagctccctttctagcctcatgcatttcaaggaaatcacttcttttctaactacaagcagccagaaaagagcagacagtaaaacacagataagacagctcaggcacagagggaggcgggggggaagtctcctgggtaactgccgaacttcaccctcatacaatggaccccagtgaaacagtgggccttactaagcacattcctttcccttcaggtgcactaagatagggaagctaaaagtagactgggggggtatgcctgcagctgcaggaagatgtatgggaacagacacaaaactctccctcccagataagcaaaatgaagagacacagaagcagtccaagcctctgataaactctcccaccctaaatctttaaaaactcttagtctgtaagagagtgggctctgatctaacttggccagaatcccctgtcaggtttgttttctctaaaataaacctgtccttgactgttgagccacctttcatgtttctttcctctttctttaattcttagaattaggctttgtgttccccacccaaatcttatcttgaattgtaatccccataatccccacgtgtcaagggagagaccaggtggaggtaattgaattgaatcatggaggcagtttcctccatgctgttttcatgatagtgagtgagttctcacgagatctgatggttttataaggggatcttcccctttcacttggcacttctccttcctgccgcctcgtgaagacagtgccttgcttcccctttgccttctgccataattgcaagttttctgaggccttcccagccatgctgagctgtgagttatttaaacctctttcctttataaatcacccagtctcaggcagttctttatagcagcgtgaaaatggactaatacaatatccctcatagcagatgaaatattgcatccttaccatggacatctgtggttaatccattggtgtaacttgacaaacatagtcagatggtgtttaaaatatattcacacttacataaatagacatcactttaagcttactgcactacttatttcttagttaccttacattacgtaacaggaataatttttttgttttatttttctataaccaactgaaagaataagtcatatcccattctagtatgttctgaaattttttaaggctttaatgttaaaagttgtcattccttttcttttcttttctcgtttttagagacagggtctccctctgttgcccaggctagagtgcagtggtgctatctccgcttactgcagccttgacctcctgggatcaagcaatcctcccacctcagcctcccaagtagcttgggccataggcacataccaccacactcagctaatttttaaaaaatagttatttctaaaatgattttgtctaaaatgattctcctactaacataggtgattttttttgtttttataaaagttaaatgttcccttatttttgagacaaggatttgctctgttacctgggctggagcgcagtggcatgatcatagcttactgcagcctctacctcctggattcaagcgattctcctgcctctacctttcaattagctaggactaaaagtgtatgccaccatgcctggctaattaaaaaaaataattttttttagagacaggattttgccgtgttgcccaggctggtcttgaactcctggcctcaagcaatcctcctgcctcagcctcccagagtgttggggttacagacatgagccactgcactcagccaaatataattcctgtcaccacaaatatctggctcagattttccttatctatcttataatatttaaaattcatagctaatgaattttagaatcttagttctgttttcattaaatagtctattcaacatgtttaagttctgaaaatgccttgatggacattgattgtatacaaatgtttcaatttatggccttataaatgatttataatttgtttcctttttaaaatgttgccatctgtaatggttatacacaaattcttttttgatttattatttttatttatgtttttgttatgtttgaaactaagcacttggttaattcatcaaaaaattacttttaaaaaaagtctgccagtgcactcatttgaaaatttgattttgccaaatgacttttaaaatttagtttttgtgcaaacacaaaaatagcaattatttgactttataaagtaaaatatttcagattactggcaaatattctttgaaagcacgtttgcttatggataatacaaataggattatttagaacgcagaacatacaatataatgaccacatggtttaagacatacgtgtaatttactgctagacatgttagaatcttctctaatgactatgagttgttaaattttaaaaataattctctagataatcctgatatctttttctttattttttttgaggcaatgtgactaaataaataaaagtttagacactttatttctttctggttaattgttctttttattcttttttcccttttttatttgttccttttattcttatgtagcaatcatatttttacactagcaataacttttcattcattcgtagtaagaaagtatttgccaggaactgtttcaagggctttccatgtattatttcattgaatcccctcaaaaacccaattatgatccccattttacagatgaggaagattaggcagagaaaaatgaggcaacttgactgaggccactctactaagtgatagagcccagatttgagctgcgtttctagccccatagtccatgctcttcactaatgtgcaatttgttgagcaattcctttgtgccaggcactattcaaagcaatggatctacagtagtgaataagacaaagtccttgacctcatggtgcttacattctagtagcaggagtggtggggtggggtgggagattgatgataaaccaacaagcaagtgcaacggaagagcatgtagagggagacagaaaagtgtggaggttggagtttctattctgtacaggttgggcaaggaaaacctctcagttaaggaatagctgaaaagagagccatgtgagttgagaaagagcaaaggctctgaagctgtgcgtgggatgttccagcaactgcaagggcatcagtgagtccaaagttgaacacataaaggcaagaatggaagaaggtgaaatcagagatgtagcaggtcttgatctgataaggccttataagtcattgtaaggactttacctttttctaccaacgaggtaggatgcattagagggctttgatcagagatatcagtgatcagtgatatcacttatgcttttgaggaatccttatggctatcatatttaaaattgggtatagagggatgagggcagaagcaggaaggccagttaggagactgctaggaaatccagatgagagataatactggtttggaccagggtggcagcaatggagggagcagtaagttgtcagattctggatataatttcaagagagaactgacagtattttctgatgggttggctggtatataagggggaaaaaaaagaagtgaagaatgagacaaggctgggcatggtggctcatgcctgtaattccaacactttgggaggctgaggcaggaggaccacttgaggccaggagttcgagaccagcctgggcaacatagagagataccatctctacaacaaataaaacaattagcagggtatggtggcgcatgcttgtggtcccagctactcaggaggctgaggtgggagaatggcttgatcctggccggttgagactgtagtgagtcttgatcatgccactgcactccagcctgggtgacagagcaagaccatgtctctcaaaataataataatgacacaaaagaaaggagccaagtgtttctgacatgagcaaatgaaaacatcatagtttccattgccttaggtagaaacactgaggaaggaggagacttggctggtggtggggagaggaatttggttgttgagatattaagttagacattgcctgcatggcatctaagtggaaaatgtctgtgtgctgttttccatgaatctggatgtagaggtatagctgcagatataaatccgcgggtattgggtatgtaaatcgtacctaaagtcacaagactggatactgtcacctagggagcgcatagagggagcaaaaagaagaggctgagaactcacctctgcgacactcccccttttccaggtggcagagatgaggagcaaccagcaaatgggattgtgagagtggcgtgtgaggtaggagaaagaagagaagcgaatctaggaaggcaagtgattagtatgtttcaagaagagagggatcaattctatcaaatgctgacaggtcgggtaagatgaggaattaccattggatttcacaccctgaaggtcactggtgattgtcaaaaaccgattgaatagtgaaaggcgcagaatcttcattggagtggggcagagagaaagtggaaggataataattggagacagcaaggatagacagcatttctttttgcccttacagcctattttatctaatattaatataactataccagccttttttgggtcagtatttatttggtatatctctttccttttctttctatctttctttctttccttttctttttttttagacaggttcttgctctgttgcccaggctggagtgcagtggcatgatctcagctcactgcaacctctgtctcctgggttcaagtgattctcccacctcatcctcctcagtagttgggactacaggcatgcaccaccaggcccggctaattttttgtatttttggtagagatgggtttctccatgttggcctggctggtttcgaactcccggcctcaagtgatccgcccaccttggcctaccaaagtgctgggattacaggcgtgaggcactgcgcctggcctggtatgtctttttcaatttttttttattgtggtaaaatatacataacataaaatttacaattttaaccatgtttacttttccattcttttatttttaaccttctgggaacttcggtttttgttgtgccttttgtaaacaggtgaaaactcaggacaggatttaaaatgctctagtactttgcactatgggtaaaaatagttacaaatatttatgtagttttggatgcttaaaagctcaactagcctttacaagaatagatacagaacaaatgaattagagcagggagaaaatggaatgagagaaaattaaaaacaaaaaatttgacagagaaaaaggcgacaaaggaagaaaaaataaaaatagaaaaggtaggacaaatagaatacattcaataagatgggagaaataaattcaaatatgttaataatcataataaatgcaatggattaagctcatcagctaaaagataaatattgtcactggattaaaaaatgcaagttatagtctgtttttaggaggcatctaaaagataaggtcagaaaggttgaaagtcaaaggatggtgtagttatattaatagcagacaaaatagatcttaaggccaaaaatactaaaaacaagaataactacataatgataaaaaattcattacactaagaagttttaatgcaaaaatcatatgcacttaatatataatgatctcaaaacatacaagacaaaagttgatagaacttctagaattaaaaatgagaaatctatcatgataccacagagcacttctacttgctgggatgtaggaggacaactcagattttatgttgctagtgagtaccttcaggtatcactacaccacttacagatatcattttccaatcaaggacaaaagagtagagttggggccaaaaaatccaggttgtaaacttggtatgaactctaccacagactttatacaaatccaggcattgtaacctaaactctttaagtcacagttttctaatcagtaaaatggcaataaaaatccctacccctttgagatgtggtgaggaataaatcatatagtgcatgtggtagaaagatcccctcccccattgtttccctagctggctctgtctggaccagatgacaaggtacagggtaatttcccttccaaagtgtcattcccttctaggtgcccagaaggtcactgttcttctataagggatttatgagagttttgggccattgaaaatagggttttcacgtgaagtttttacaatatgtgcagtggaatgacatatttgttttagcagaattttaatactgtgttcacttgtggccaactatgtaggatgagatgctccaaatgtctcctcattgtcacctccatgagctatgccccataaaccctgggaaaaactggatatgaacatgccctcattgggacctcagccctcacacctaggttctcagcccctttgccatttcttcttcctcctcctcctgttcttctcctttcttcttttcctcctcctccttcatctttctttctttctttctttctttctttctttctttctttctttctttctttctttctttctttttctttctttcctctttctttctctttctttcttttttctttctttctttcttttctttcttttttcttcttttcttctccttctccttcttccttctttttccttcctcctcctcctcttcctcctccttctcttcttctttcttcttctctccctcttcatcctcctccttcctccttctttctttccttctcttctttcttctttttttctttttttcttcttcttttattctccttttcccttcttcttccttctcccatccaccttctcccttctcctccttccttcctcttcttcctcttccttttttttttttttttttttttgtagagatgaggtcttgctattgctgctcaagctggtcacgaagccatttctaaacattttctattctcatcagctgaacaagaatctggacctaacatttctccctgcccaacccaaccataatgtatcacctacctaaaagccattcttttttttttttttttctaatttggtcttgaggtctgtctcatgagagtggccataaactctaaccccatcctgttggggctccagggaatgtggttgtgggtgtttacaatgggccttccagagaattctttgtcctggtgggcggcttagtgcctgtgtctgacgcatgaccaggtgtccctctcccagaaaacctgttcattctggcagacgcccttgtggctcttgtctgacctgagtccagcttattcccaccaagatagccactctctaggagagctctgaccgggagagaagttaggtttgggtgtgtggggcaggtgagacgcagagaggcaactcaacagaacacatgaagtcatggaggcagcgcattcatttcaggtccagacggaagagggcagcacacctcacagggccaaggggatgcagagagctgtccacgacacacatgctcagccagcgagtggggacagagaagggtatgtggggacggacctgtggggtgaagcctttttgggggcctagggcattacctgagcagctttcccatgaagagttctaattggtgggtgtagagcaagcaggcgcaagttccatggagtcaccccgtcactgggaggtggtcactgcggcatatctgtgcagtccacatggggtgtggggattagaggggcgagtcaagtgggttgcgtctagctgtccgttgggggaggtggtcaccagcaggtgattgtataagcagttatctgggtcgaccacattgaggaacaggtggagaactggagactgtgtcaagggtgactaagccctgcttctttcttgtatgagaaagtccaacttatattcagactggatgtcataaaattctaggaattcactacagccttgctctgtggggtgtagaaatcccttcacattggcacttggtttgggggagcctgttttggaaagtccccactcttccctcctgaggctgctaaaataaactgttaagccatgtggtttgtttgtttgttttgctagctccgctgtgttagccacgaggatcacagccagtttcataaccatacccctttccaagttgcacttttctttctctttcagtggctttagggcttcttgttttcccttcttgaccatctgtaatacaagaaagaagttgggaatggggtcgtaatgtgtctggtaaatcttatgattcattcataattgggaaaatcaggaaacaatccaaatatctctcaacttgtgaatgggtcagcacattgtgattcatccatacaatggacttatttattacacagccataaaaagaaacaaaattactgactaatacaatatggatgaatttaaaaagcattatgctgagtgaaagaagccacacaaaaaatactctattttgtgtgattatgtgactccatatgcatagctctgtactgtatgattatccaaaaccctagaacaggcaaatctagtctctaggggcagaaagaaggtcattggttacctgtgatgggagacagtatatagactgagaaggggcatgagggagccttctgggggagtatctatatgcggatttgaatgagttgtcaaaaaccaggcattacacttataatgtttgagcacactgtatactttactgtgtattttatcccccaataagagaaaagttaaaataaaaaacgtacagatataccatggaatattatgcagccatataaaggaacgagatcatgtcttttgcagggacatggatggagctggaagccattatcctcagcaaactaatgcaggaacagaataccaaacactgcatgttctcacttataagtgggaactgaacaatacacatggacacggggaggagaacaacacacactggggcctgttgggggtgggggtgggggtgggggtgggggaagggagagcatcaggataaatagctaatgcatgtggggcttactacctaggtggtgatgggttgataggtgcagcaaaccaccatggcacacgtttacctatgtaaaaaacctgcatatgctgcacatgtatcccagaacttaaaataaaattaaattaaaaaaagaaaatattggactccagttaagacaggctgaatcagaaactctaggggttgaactcagcaatctgtgttttaccaaacccatcaggttattctgatacacactaaagtttgagaatcgtggcactgaaaaacaaaaaccaagaaacgtagaacacaggatttacctcagaaaaataccagcccatgcctttgcaaagaaacataggtgtgttttttcccaaacttatcaatgttttcacagattctttctacttttctaaccttagcacctgcagggatcctcccttgtggccctctccctgcttgaagtcccacccgaaaagcttggggacatagcagcagctgcctcggtacagaggactaataaattttgtttgatgctctctctccatactacaatgcctggaccgaggttagtgccataaatatgtgccaaatgtatgaaggtaggtctccctcagcttccaagaagtcatttcatctcctggactttttttgaggtgcgtggctctttatgacttatttggtttatgtgcaagaaaaatcctttctcagggagggagggctgcaatagggtggagcagtaggggctgtttgttgctctgctcccttaatttccatctttatctgtttcctagtggacctttgccaagagtcagtgtccttgtgcatttcacatagacaagcatacaagtaactatcttgctggtacaaactgatctgaaatgcacattcccacagtatttctgattgtttcctttattggagcataatttatatgcaacaaaatgcttccatcttgggtatatagcacgttgagtttttacaaatgtatagacccatgtaaataaccttcatctctaccaagatacttctattacctcagaaagttccatcatagtctcttcccagtcagtcctcttcaccagtcctaaaacttcatgtaaatggaatccatacaattgtactattttctttctggtttcttttattcaatacacacacacacacacacacacacacacacacacacaccacacatatacatatacatatatatatatatatatatatactgaataaattatatatattagagggacagggtgtcgctctgttattcaggctggagtgcagtggtgccatcatagctcactgcagcctcaacctcctaggctgaagcgatcctcccaccttagcctcccaagtagttaggactacaggtgcaccaccaagccctggtaatttttgtatttttatttttgtacagacagggtcttgctgtgttgcctaggctggtctcacactcctgggctcaagcgatcctcctgcctcagccttccaaagtgctgggattacaggtgtaagctaccacacccggccttattgggcacgttgcttttgagattcctccatgctgttgcatgtatcagttttttgttcctttttattctgaatactattccattgtatggatgttcctcaggttttttatccaatcacctgccgatggttagtttggggttattatgaataaagttgctatgaacactcatgagggccactgggttgattcctggaatggaaaccataacttgcttcaggagtggtcagtgtttctcttctccatgagtcagtttcagacactatatggattagtaattggcaatctgaaagatcagtggttgaagacctgctgggggcatggcattggggagcctgtgttggacattattcaaggttctcataaaaggttgctaatggcccactctgggacatagtaattggttattactgtggataaatgttaggaggaacctgggccatgccagtgattgggggaccttaaaatgcccactgcagtccctgtagttcagccatgggtggattctgctggtcagtgattggcagccagaggaatcagggtcatggttccagggatttgggacctgaggttaccaaagatcaacagtcctaagttggtcagctataggtggacctgatgctcacctgatgtttggtgtccatcaccaaaagaaggggatggggaaggtaagtttgagttttttgtctttgtcagagagagctgtgtagatttccctgaatgtgcactgaaatatgtgaaagatctgtttgtgtgcacgagatatcatccctcagctggaacgcttgcttagaagacggtggaaaatagaaataccatttattgggagccgactctgtatggggttccatatggcgtttcagctgctactattatataatgggccaaatgataatcattgttatccagctgacagagttgctgtgattaaattaaatgaggtacctgacatctgtccccagagcctcagggcaggagcaggtgagtcagaggaagctgcagattctggacctgctgccttggagacagattaggatcctcccaccaagagtgagcgccacatggctgatgctgccacgtccagggccctgcgtgtttcaatggactgtgtgactcagctggtggagaagaggggatgtggagggtctagccccatggcctagggaagaaggaaaaggcagctccctgcagggtgtctgaaggggaggtccgggtgagaacagccactggccacagccaaggagatgatatcccccaccccagcagggacccttccctttcatcggttctttacagacatcagctgatccccccagagccccgttcccgctccccggcacagtactgttaaataaactatagacttaattcaaatttcaccagtttttccactaatcttttttctgtttcaggaattcctcccatgttttgtttctcagtccttccttgcctttcatgaccttgacactattgaagaatacaatttaggtattttgtagaatgtctctcaatttaggtttgtctgatgtttcccatgattacactgaggttacacgttttagcaagaatgctgcagaagtgttcttagggcatcttactgggaggtatgtgatgtcgatgttaaccttgatcctttggttaaagtaatgtctgccagtttctccaccgtaaagttcctatttttcctgttgtatttaataaatatcttggaagagatactttgagattatgcaaatatcctgtttctattcaaacttttgcctgcaaattttagcatccatttggtagatcatgcttgcaacaattattaccgtgatgcttgcccaatagcaattttatgttttctcattccttctacatttattaattggaattcctctataagagaaagctatcctggctgggtgccatgactcacacttataatctgaccactttgggaggctgaggcaggtggatcgcttgaacccaggagttcaagagcagcctgggcaacatggtgaaaccctgtctctacaaaaaaaaaaatgcaaaaattagccaggcatggtcatgcacacctgtggttccagctactcaagaggctgagggggaggatctcttgagcccaggaggtcaagactgcag[132 bp omitted]tacatcactataaacgtgtggctattttattgtacagattattcttcaatactatcattatttattgtgttactcaaattattccatctgtggtaattgggagctccttaaggttgactcccgtgtccttttaaaatatttaaataaacttttaatttagaagagttttaaatttatagaaaagttccaaagatagtacagagagttttcatataccccttacccagttttccctattgttaaccttccatattgctatggtatatttatcacaagtaatgaaccatcattggtacattactgtggactaaactacacacatcctttggattttgctagttttaaaataatgtcctttttgtgttccaggatctcatccaggatgccacattacatttagttgtcacatctcttcggtctccacaatctcctttagactgtgacaattgcttatacttttcttgtttttgatgaccttgaaaattttgaggagtactggtcaggtgtttgatggaatattcttcaatttagatttgtctgctatttccctcattactggactggggctttggattttgggaagaataccacagaagtgaagtacccttctcatcacttcacatcaggggtacatgccatcaacatgacttagcactgacaatattaaccctgatcatctggcaggcatttgccagatttctccactgaacgttccttgttctccctttttcatactttgctccttggaagcaagtcactaagcacacacatatctgggggaggagtgggaggttaactaccacctcctggaagggtggttatctatttacacaagttatttggaattttccaaaggatttgtctcatctctcctgtttattaatttattcaatcttgtgtttacaacagcacggactcatggacatttattttactctgtgggttataagccagtactaccactgtttattttgttcctcagattccagctttggccatggggagctccttcatgctggttcctgcatccttcagacatgccctgtccttctgtgagcactgtcttactttctgaccccacaagatatttcaggctcatcttgtagtttccctgctccagtcctggactcagccacttctccaagaacctctgattctttttcttagagaatggtattgagaagccaagatctggggactaagtgttcaacttgtgttccactgttactttaatgtatccctggaatccaatcaagagatagaaaccacatggtagtttaaatagagaatgtttaatataactattaactataacaggagattggagaaatgggggattggctagtaagaggtaagaagaaccctcactgctcccaaaacaaaggaggaatatcagatttagggagtagccattgtccccagtgcctaagaaagaggccactctccatctttccaccccctctcagaaccagacctcactggaaagggctccactgtgacctactggatggcagagaagattgctggggtgctttggaaatctgccctctgtaatgcagaaggaagctgtccatgggcaggagtcatgctttggaactcacagcaaagtcactagagggctgccgggggaagctgttcatagggatgtgccacatgctgctggccactgggcactgctggccacctagagatgcattgtgtaagccgcagatgctgcaggagcctgatgaggggagctcatgagaaccaggaagagaaatctcttcctcttccaaagtctttctagtgccctctactgataattggaacatttaggtgaattcttctgtttcccatgttcttcagtgtcactatgctattcatttttaatacatgtatgttcatttgttagtttatatgccatttagagtttcccccacatcatagtccattttgaatttgatttttttagggtatgtgaaacagtatggttccaagagaaaaagctgcacaaaaggtcccttcaaagaagtgccacttatctcatccctactatcctgtccctttcccaccatccccttataagtaagtaatctctttagtttctattatagtttattcacctgtatttcttttgcacaagtgagcaggtacatgtatgtcttcttatatcccttctttctgtgaaggatagcatacagtagatattctttagagctttgctttttcacttacagatatgtcctagaaatttttctgtattaattcatgatattcctctttttaacagttacctagtactccattgtgtgtatataccttagtttgttcaactactctcctatgtatagacatttatattttgtaattacaatgctgtaatgaataactttgtgcattgtattttgctattgttagagatgtatcttcaggatattgttaagtattctccaattcccctccagaaggactgtaccagttttcattcccaacagaaatatgcaagagtgactgttcccctacagcttcaccaacataatatcttatcatacttttaatatttaccagtccaaaagatgagaaatgaaatctcaatgttgttttagtgtgcatttctctaattataaatgagtttgaactttaaaaatatgtttggttgaataatattccattgtgtgtatatatatatatcacattttcttgatccatttgtccattaatggacaggtaggttgtttccatatcttggctattgtgaaaaatgctacaatgaacatgggagtgcagatattttcactaggtggtgaaatattattcagccatataaaaggaggagatcctgccatttgccacaacatagatggacctgcagaacattatgctaagtgaaataagttagatacagaaagaaaaatattgcatgatttcacttatgtatgaaatctaacaaacaaaacttaaaatatccagatatagagaataaaacagtggttaccaggtgtattagtccgttctcacactgctgtgaagaaatgcctgactctggatgatttataaaggaaagaggtttaatagactcacagttccgcattgttgggggggcctcaggaaacttacaactgtggcagaaggcaaagagatgcaggcaccttcttcacagggaggcaggacggagtgagtgcaaacaggggaaatgccagatgcttataaaaccatcaggtctcatgagaactcactcactatcacgagaacagcatgggggaaaccgcccccatgatccaattacctccacctggtcccacccttgacacatggggattatggggattacaactggagatgagatttgggtggggacacgaagcctaaccatatcaccagggatggggttgggtggggaggaaatggggagatgtagctcaaagacacaaagaagcagatatgtgggatgaacaagtctagagatctaatgtacaacatgaggactataggcaataaaattgtgctgtaatagggatttttgttaaataagtagattttagttgctattgtcactaagaagtaactacgtgagatgatggatatgttaatttgcttcactacagtaaccattttactatttatatgtatctcataacatcatgttgtaaacctcaaatatacacaataaaatttattttaaaaataaaaagtatgtttggtgaccatcatatatctttttttgtgaattgcctgttcatgtcttcttcccgcttgtctgtaatgtttttaggcccttgtctctcaattttaatagccctttatatcaggggttagcaaatgagggaccataggctaaatctggcccaccaccagttttttatttatttatttattttatttttttatttttgagacagagttttgctcttgtcgcccaggctggagtccagtggcgtgatcttggctcactgcaacctctgcctcccgggttcaagtgattctcctgcctcagcctcctgagtagctgggactacaggtgcatgccaccacacccagctaattttttgtatttttagtagagatggggtttcactgtgttaaccaggatgttctcgatctcctgacctcgtgatccgcctgcctcagcctcccaaagtgctggaattacaggcgtgagccaccacgcctggcccacccaccagtttttataaccaaagttttattgttgcacacacacactcatttgtttacatattgtctataccgtttttacattataactgcagagttgattgggtatgacagagatcatatgattcacaaaaccagaaatatttactatcaggccctgccttagtctgtttgggctgctataacagaataccccagactgggtaatgtataaacaacagaaatttatttttcacagttctagaggccggaagtccaagatcaaggtgaaggcccagtctctgcttccaagatggtgacttgttgctgcattccccacatgcagtggggaaggtagaagggcataaaagggcctaagctacttccctccagcccttttataagtcatgaatccattactttaatcagttcccaaaaggccccacctcttaataccaccacaatggagattaagtttcaacacatacattttggggaacatttagaccattacaaaaggccctctacaggaaaagtttgttgatccctcctttatacattagagattagcccttgtctgaggtatatatatttcaagtattttctcccagtttgtcagttgtcttttgactttgtttatacttttccgtgcacactaaacaatttttaatgtagtcaaatatattcatctttgattgcctgtggattttgagtcatagttagatactttctcatgatgacttgaaagccatggtttcattctgtttgggatgttgatttagaatttccttccacttaatgattgttgggaagaactttccttagttatgtatgaaatttcatttcctgattttctgcaacagctctctatggact[244 bp omitted]ccaggatagtctcgatctcctgacctcgtgatctgcccatctcggcctcccaaagtgctgggattacaggtgtgagccaccgcgcccggccttctcttgcctccttttatggcattgggtatttaacaataggcctaatttaatggtatgaaaaaagtaggtataaaggacaatttgggacaattgcaaaatttcattatggaatatggattcggtaatagtgttgtatcaatgttaaatttcctgcttttgataattttactgcatttatcttaagagaatattcttgttattaggagatacacactcaaatatttatgaataaaaggaaacaatgttccctttttcatggttcagaaaaaattatacgtatataagcaaatggggtaaaatgtaaattattggtaagtttggtaaagaatatattgtaagttttgtatactataattgttgcttttccataatgcacaaattatatctccctagacaggtagtgaggttggaatttagtttttagagcaacggacacttctgtgctccgtgaagcacatataaatgtattaacacataataggaaaaatgcaagcttcatggggaaagaggatgtgtacttaatacagatgtttctccatttatgatgggggttacatccctataaacccgtcataagttgaaaatatcactagttgaaaatgcatttaacctactgaacattgtagcttagcctaacctaccttaaatgtgctcagaacacttatattagcctacagttcagcaaaatcatctaacataaagcctattttataataaagtgttgaatagctcttgtaatttattgaatactgtactaaaagtgaaaaacagagtggttgtataggtattcaaagtatggtttctattggatgcatatcatttttgcactattataaggtaaaaaaaaaaatcataagttgaaccattctaagccggggaccatctgtactgaatttggtaatgaactagatttttttttgagacagaatctggctctgtcacccaggctggagtgcagtggcatgatctcagctcactgcaacctctgcctcctggattcaagcaattctcctgcctcagcctcccgagtagctgggactacaggcatgtgccaccccgcctggctaatttttgtatttttagtagagatggggttttaccatgttggccatgctggtcttgaacttctgacctcaagtgattccccccacctcaatctcccaaagtgttgggattacaggcatgagccatcgcacctggccaaaactagatttttaaagacaattttttcggtaatttgtggcttcaagctcatatacacaattatttttacaggttgatgacttttcatttctacatttatgtgttgcttattgaatctgagacaggagacatagaaacaatttttaactgaggagtgtaatttttgcataaaacgttgttactatttttgctttaaacaattattttaaaagaatttaaacatgataaagatgtcttttatatttacccactgctgtggaatgaactgtgttcccctaaaagtcatgttgaagccctaacctccagtatgttggtacttggagatggggcctttgggaggtaattaggtcatgagggtagagatctcatgctgaaattaacacccttataagaagagagctcctcttcctctcctcctctcctcctccaccacaaatagagcaagaaggcagccatcagacagagagtcctcaccagacactgaatctgctagtgccttcatcttgaacttcccagcctccagaaattgggaattaaatgtttgttttttaatccacccagtctatctatggtattttgttatagcagcccaagtgaagacacccacctatttaacatatccatttgacattttccttctgccttctgatttcacttaatatttcttgtaatgctggtcatcttaatttatgacagatatttttatggggcatagaattctaggtcgagagctttaatactttcaagaagtcctctggcttgctttatttctgataaatagcctattgtttttcttatctatgtttctctgtagatagtgtatctttttgctttgatttccttaaatatttcctattttcaatcacttgtttctacactttaattatggtgggccttggtgtagttttctttaggggcctatcatcctcttggaatgaatagatctctacctctgtatcttttaaagatataattgacatataataaacttcacatacgtaaagtacattcgatatattttttcatgtgtatatatctgtggaaccataacagtaaaaataagagcatatccatcaacacaaaaagttttctcatatgcctttgagattcttcctatctccccatatttaggcaaccactgccctgctttctgtcaccatggattagtttgcattttctagatgtgtgtataaagggagttatataatatgtagtcttttgagtctgacttctttcacttagcataattattttaaaattcatcaaacttgcgtacgtcaagaagtcattcctttattgctgggtagtattccgtcttatggatataccagaatttgtttatccatttacctgttgatgggcatttgggttgtttccagtttttgctgttctaaataaaactactatgaacatttgcatgcatgcttctgtatgcatacatatttcctttcctttcgggttaatacttaggagtggaatggctaagtgatgtggtaggtatatatgttaaacctttaaagaaattgccgaactgttttccaaagttgtactattttacattcccaccagcagtgtaggagacttccactcctctgcatccttgccaaaacttggtatggttggtctttttaattttagccattcaaacaggtatagtgttatctcattgtggttttaatttgcattttcctagtgactaattatattgagcatcttttcatgtacttatttgccatctgtatattttctttggtgaaatgtgtgttcaaatattttctctatattttaatttggcctcacttcctatgaattggtggctctattcccagcttattttaccataaataggtatagctaccttactccctccaccaaagttaggagaacattatgactttaaccaaataacttttcatgcctcactctgacctccttgagactactctacagaactcagacttagaattctttgtagatgggtcatatctaagactgaacaaggataatttcaagctggatatgctgtaaccacttcctaagagcctattaaattcaatccccttcctgaagtcaagtcagcaaaaggaagtgaacttacaggctggacttcagcctggaagtgagcaagggataaaagagctaacacatacacagattgcaggtatacgtgtggtgtggtttatgattgccacatgatatggcaacaacaggatttcctaactgctgctggtactcttaagcatagtgagcacatttgagcatttctagatgtctttctcctccccatggaattcatttcacatgaattcagttagttcaccaaattaaagatgacttggtaactccagattacttctatgaaatcttcagcaaattgcagtcacaaataagtaacagattcagaaaaaaaagatattgggagagaactggatgtgctctttatggagacagcaaaacagttgcttgatttctccagaagttatccattctctgggatgggagttggtaaaaatttgcacactgtggcccatcatagtcaagaaaatgtaaaactattctgggacaacattggtggggaaattttaatcaggtagtagacgaggtctccaatgaacattccgcctgccagactcacagccctggaaaaactataaaaatgggacataggaactacagtcttgaggactttttgaacattgacaaatggactttatataacttcctactgatagaggcaggcaaggtagggtccttgccaaaaacttcacctttgagctgaaaagcctgaaacccatggcctaaagtgaaaacttctatccctgttcgcccactctctcccaattggttctttccgaataatgcctttttaccaatcaaatattgctttttccaagattagccatggcccgccccaccaccacagtcctgtgcctataaagaccccagactcagctggtagaagagagagagacaatttgatttcagagagaggcaacctgatttcagagggatggctggacttcagagaagagctggccagagacagccagactatgggggaagattacctgtctgtcttgtccccttttcagctcccactgagagccactttcatcactcaaagcaattctctgcattcactgtccctcaatttgtcagtgtgacctcattcttcttgggcactggacaaaatcttgggactcaccgagtgcaggtacctaaaaaaggctgtcacaatggtcctttgctcttgctggcagaggacagccaccccatgtgatgaggcaaaggtataactgagctgataacacactgctgtccatggatgacagggctaagagagcattataatatgccctctggggcctcaggggttgcaggcactcccacctgggtgctgccacagggcccacatggagcttgttcctcctggtgcccaaagcagctggccagatcccacactcacttgctagcattctccctctcataaggggttgagtgtggtgggctgagtaagtggggcacccccgtcacaagtccaatgaaggggtcgagagaattcctgcatcactacgtcatgtggatctgaatacatatttactgttttctgccttttctttggttggccaaaagcttcccctggttgaaaagcagtggctctgtggctaaaaacagtaggttttgtctttcctacttgggaattccctgcttacttctcttactggccgagatactaaatttatggggaccataattaaggaactttgtaaggtgctgcctattagccaaaaattacactttccttaccatccctaatcctcagaaaaaactggagaggtactttaaaattaaaacttgctaaactctctgaagacttataattaccttggactaaggttctccaattggccccattgaccatctggtgttcttctggcaaacatagattgttatcttatgaacttgttacagccagaccaatgaaattggacatcacatcccttattttagactctactttgttgcaagcagatatggctcaatactataaaggactaatgggatatactcagattcatcatcaaacaggttcaaattgccttttcaaaggagccaccttctaagcctctgcatgacttacaactagaaggcttattctaatggaagagacacgagtgaaaaactgctctggagctccactggaagggcctctaccaggtcctccttaccacagctaagttataaggaatagataattgggtctatgtctcctagataaagagacattgacctttgatggactggacttctactttcactggaaactgagagatccctgaaacacttctgaggcagacaatggcatgaaggagacatttccccaagaatataggaacaagcagatgaccttgaacagtgcacaccttctgctcaagatgatggaacaaaatatctttttgatctttattattttccttttcttcctagccttgtttcttatcctttaccttttaatttctgaatttgtgcatctctatagaattacagtagttctcccttatccatgagagatgcatttcaagaccccaagtggatgcctgaaaccacagatagtaccaaacactatatatactatgttcttccctacatatacatatctatgataaagtgtaatttgtaaattaggcacaataagagattaataacaacaataataaagtagaacaattataacaatacactataataaaagttatgtgaatgtggtctttctttgtctctccctaaatatcttattgtactgtactcgtctattttcagaccacagttgattaagggtaactaaaaccatgaaaaataaaattgcagataaagggagactattgtatctctaagtgctgggcataaaaatgccctttccttttttttcagagatagggtcttgctctgtcacccagactggagtgcagtggcacaattatagctcactgcagcctcgatttctcaggctcaagcaatccttctgcctcagcctcctaagtagctgggactataggtacaacaccatgcccggctaatttttattttttttgtagagatgggttctcactatgttgcccaggctggtcttgaacccctggcctcaagcagtcctcctgccttggcatcccaaagggctaggattacaggcatgagccactgcaccctctccttatttctctgccacatttcatttctcttctctcctttccttaatgcccaaagttcttggatttttttttaagatttatgattatgaagctaatgtcacctatgatttttgcttttgctcacttttttttctgtcagttccattgtaccttcacaaatactactcgttccttacttgttcttgaccctgagagaactctccacaccactattgctgttgtttggggcatagtccccaaactgggtctctgacaaatctccaagattaacaaattatattctgaagaggtagaacttgtttttctggaaaggctgaagcaggtagatgttgttggtctggcctcaacactatcttcacccaggcaaaccacaatgataaaagtatgagtgttttttagatgctggagagaccccaggtgattcgtattttgttttgaggtctaaggattgctgatttttgccagcaaattggacagggtcatgctgtctttcccatctctttcctctttctgactatacaattggactgagtttgaacaatttatcacatttttagttcagaagttaaatcctagttcccaagccagaagaaaaatccaccctctgaaaaaatgcccattcttagtaggtgatgagagggactgtgtgaagaagctgaaagacttggaatcaatcgaagtgagatctccacactcagcgaaatgttttatgttgcatccatcccttaagagattagccctgtggactattcaagttctacacaatgcctagttttccaggctttcatttgtgaagccacccaagccactaaccatgttaccaaaaatactgacacactcaagaaattcaggaactccggaaggctggtgttcgtcgttgactggcattatagatcatcctggcatctatgggaggtatatgcgccgctgttgaggatgaatgacatacacagattccaaaaacctttctgatgtctttttggtgaatcaacacatctgtgaagccaaccaaaacatttatcaggtaagcaacagagttctgattcctgggacctatgggctgtcatcaggtagatagggatgggacatgtttccctggatattctgaacagggacatcattctgaggatatacttttctccaaaggctcggaagcttttactatttttcctgataggaatatctctaatcaaatgcattctatcatgtttaattaagaccaccagtactgtcctgtccaaacagatgatccaaactacaattaaggaacaaaagatcaaagaacaaactgctcctccactgctcatcgtcggagccttctttacttaattcttgaatcttatacattcctgtacttttgttttatctctctatagatttggccagtgaagaaaggagtttattttggccaagaggaagagttataaaagaatgaaaacaaacctcagtttttcttgtttcaacctttgcctcctttcccttgttttcttattctccactccacacccacttcttaaaaactatctccttcccccttgaaccttaaaaaactgcgaggattaaaaaaaacagctctcaaagaactgttctgaaagttgcaggcatgggattgcaccaataatcctgagcaaaaagcatgaaaaactggatcaatttatcagtggttccaaccagaaattttcagcaggtacagataaaaaaaattgcaactgggaccagactgcattcatatacccttctgttcttcttgcctaacataaactaattctgcttcagtacaggaggcttcttgttcttaagattttcactgatgcacatcagttgaataaaatatttaaacactatttgagtgacattattttttttcctcttgatagggtcatgttgtggtaattaaggggttaattaatcaaaaggatataacaatcttcaatgttaagggatctaataacaaacagagcttcaaaatatgtcaaataaaacctgatagaactgcaaggagaaatacataaatttacaattacagtcaaatatttcaacactcctatcttaataatcaatagaataagtagacagaaaataagtacatacagtcccagctacttggaaggctgaggtgggaggatcgcttgagtccaggagatggagtctgcagtgagccgacattgtgccactgcactgcagcctgggcaacagaaaccctgtctcaaaaaaaaataataatacttttaattctttaaaagcctgatttttttctttagttgacagtatttttcagttctaaaatttccatttggaaattttatgatggcagagccctcatgaactaatcaccttccaaaggccacacctcttaatactgccacattaaggattaagttccaacctacgaatgctgggagacacattcagattatagcaggccccctccattttctcctgaacatgcatgcagatttgctcatgtgctgtcttccagaccgcttgggataagtaggatcttatcaaggccttttttgtctgtctcattccctgtatctccctgttaaatttattactgaactgttgatttattacttaccccagtcagtatcaagacctcagaatgtctctgatattgacctttcctggttgttagccactgagatcactgttgttttattgtttgtttgtttttgttttgagacggagtcttgctctgtcgccgaggctggtgtgcaatggtgcgatctcagctcactgcaacctcagcctcccgggtttaagcaattatctgcctcagcctccagagtagctgggattacaggcgcccaccaccatgcccggctaattttttttgtatttttagtagagacagggtttcaccattttggccaggctgatcttgaactcctgaccttgtgatccacccgcctcagcctcccaaagtgctgggattacaggtgtgagccaccccgcccagctgtattcagaatttttataagggccaggagtaatacttttgtttcttgacagatttttcacaagtccatttaatgtctagatttttatgttccacttgccctgaggattgcagatggtatggggcattaaattttaatgagtactccagagattttgcaagcaagaggtttatctctgatgtaaaatgagtttctttgtctgactcgatccataaagggatgccaaagtgaggtatcatctcagttatcaatttcctcaccactgttgtgccattagaacctccaatccatccatgaaacctgcagactatagccaaagagcaggacaagccaaggctggaagtaaatctatgaaatgtatctggagtgctgcaaggagaagcgtgggccttggaagactgcctgaggagtgttggtttcctccagaaacgtgatgagatttacaagtaatgcattgggaaataatttggacagaaattttgtagatcccagggtaaaatcaattattctttagttcctcaactatccctcatatgcacatatgtcccatccaatgagacataagtacaagccaaaaggttaaatgaaaaggggccacaggaagtccatttggcccaatatacaatccatctgataattacttggcacccttttgtacccatttatctttttcatattttggggcatttgcctgaaaatgaataatatcaggtagggataaaggtaagtttataaattgggtggaaaaataaaaagggggtcagtttttggctgtgtgcttagcagccttttctaccctatcattcctaaagatatagtgtcagtctccttagtgtgagatggacaatgaacaatagcaattttagtatgaaggtgaacagcctgtgataaggcagcgattatatgtccattagcaataggagtaccagcagaggttcagaatccacgggatttccagattgtgccaacagcatgacagactccaaaagcatatcggagtcagtgtaaatcatgtcagtttttccttttgccaatgtgtaagctctaataagagctataggttcagcagcctgggctgactttatagtcagcaaagagtatgcctcaagcgtttcatgtggggaaactatggcatagccagttattatgtttcccttaaaattaaatttgcgagagccattacaaaatagcaacacggctaggttgtctaaaggagagtctgagagatcccttcatggctttgaactcatttctatagctgctaggcaatcaagtggaatggaatgaggctcttcatcatcagggaggggtaggagtgtagcaggatttagtgtcacaaaggcgtaagatgatggagggattggttcacagggcttgctcctaggtgctctgtccatgtgtagagaggtgctgcatcttaagaacttgaaagagagcggacacagcatgggaaacattgaggtggatgggggaacctaatgtatgggtgctggcacccatacattaggtaatacagtaattagggcggcagctgatgctactgcatgcaggcatgggggcgtgtctgctgccacagtattccattggcatgagaaatatgctacaggttgtatctgagaggcaaagggttgccctagaatacctgcagcaatctcactattttcatgacaatagaggtgaaaacgtttatcaaaattaggtaagccaagagcagggggtagggcaatgctaattttgaggcttcaaaagaagttaatgcctctgaaggccagagaatggtctctggagtggtatctggaaggagggcatatagtgggttggcaatagccacaaaattaggactccatggtggtcaatagccagctgcccctagaaatttacacagctgctttttcattttagggagaggaatggataaaactgactcgaggcattttggggtgaacttctgagtgccctgaggtatttcatgttctaagtaagtaacagttgtttgcactaactgaagtttagatctagaggctttatggcttcagtcagctagtgcctttaggagagtgagggagcgtctttaagggtatcctatttagtttggttacaaagcaaaagggcaaggtcatcaatatattgcacaagaatggagtcttgggtgaaggctacagaattcaagtaggctttaaggattagagagaattttgagagtgacttacaatatccctgaagcatgcgagtccatgttaattgcctccctctaaatgtaaatgcaaagagaaactgagtcagggtacaacggaaaggaaaagaaagctgagcagaggtcaactacatcaccaggaattgaggtagggatagtagctgcattggggataacagggtggcagggaattacaaatcttgtacaacttacaaatcttgtacaaatagatttgatttccattggaagcaaattttctttctttctgtactggtaagattggggtgttacagggtgaagtggtgaaaatgagtacaccttgctgcaaaagggagtctatgataggttcaattcctctctctgcatcttgtgagaaggggtactgagctactactgatgggaaatgtttgttcctttttcatgcaatgtgtaccggttctgtactcagtagtagtccaatctcacttgcacattaagcccagagacaagctgggacatcttttaagattgcatcctctttagaggaatttaaatcaaggggggtttccatgagagagcgtgttaactttaatactaaggttaatagaaagtttgaagtttgggctgaaggcagagacataaaaacgccttccttattacattgtatggcagcattaaacctacataataaatccctacctaaaaggtttgctaagtgaggagtcagaaactagaaaggcatggcaggtgttaagagggcaaaggatgttggggtgtcctgagatatgggcgatgaaataggttgcccagagttttcaatagcttgaatagaggcagaggtaacaggtagagataattcttctgagtgaatagtagaggaagtcctatcagtgtcaattaaatccggttcttaatcctctactttaagttcaatggtgggctttgaggtgcaactgaggatcagctgaccccatcaatcaatgtagtattgtcccaaaggaggggaataatgagccttctaaaggtgttggattctagggagagtttcttcctttttttttttttttttttttgtacaggacagcaatttttccaatgcctctgccttttgcaatatctgcaaatttcagaagacaaactagaaaaatcttgtggctgaccaaagatatgaaagaactttgagtcattcttagaggcacgcctttgtttctgtaacaattcaagccgcaagatgacttgattttagttctttttttccctttattttcttgcaagctattttcaaataattgagtgcctgcttccattataatgcttacagactgaccagcccaaccactatactagtttggatttgcctttttgtatcaagaagatttccggccagagcagaaactggaatatttctatgctctggagcttcaggatgtaatgctgcatgcctttgaaaaccttgtatacgtctcttgacaaaagccttggggtgctctccctcgttctgaatacataattcaacattagacaaatttaccttgggaggagagcctctaatattgtccctatcaggcccctgaatatcagcaactagttgggcctatctcctcatttgcaggagggccaggaaggggttccggccatctgttcactctgtggagggagttttccccaggaggccgtctggcctgtctaataactgcagtatgatcatgagagggaaatacaccccttagcagccagtcaaggtctctacgtatggggttacagatggccaatgatctctccaactattctctgaacttggtaagtccttctgaaagtgggggcaaaattgctttataatttaaaatatctgttgctctccaggagacgtgaattctttgagaagggagtccaggatacatttacagagggcattgcatagagaggtctggagctgatggagtctgattacaaagccttgggaaataagagaggtttcaaggcacagaaaaacaagtcttgttgggtgtccttggagcctgtgccagatttattttgtggtagtcagttcttacataaatgacctctaagcttcaggttttaagaccaggcctgatttgggcttttaagatcaggagggtttttgtaaatcatccagggaaagagagataaaagaaggcagctggatgtctaaggagtttttccggggtttggaggagcagagagaatttgttgagaagatagaggaggagggagaggctgaggagatggggctggatcttgaggagggggggttcaattcaggggcccagagagtgaatagatcctctggtgggtcagggacatggagttggggtgtgagtggagaagggtgatttatagtgggaagggggatttatagtgggagcagatttcaacttttgttctaggtctgcttttgttctttaattttgttaaggaaatttttagggctagtaataatacttttctgaattttttgttctgcctgatcttcccataaatacaataagcaaatagtttagaataagcgttctctaaaattgttttcaaataaatttgaaataaaatttttctttctaattcaaaggatctgtcttctggtcattgacaattaggatcttcattggtgtatagattccaattgcgacttaattcaataaggcttttatggaaggaccacgtggtaactttccaggcttaggagaaatctttactagggatgcaaggagtgttcctggagtgggtgcagaagatgcagcccccatgattcaaaaattcattctcagagatagattaagaaagcaaagaccttggctggtgcagtggctcatgcttgtaaccccagcattttgggaggccgaggtcagaggattgtttgagcccaggagtttgaggacagcctgggcaacatagtgagattcccatctctataaaaaatgtgaaaattagctggatgtggtggtacgcttctagtctcaggtacttgagaggctgaggtggaggatcacttgagcctgggaagttgaggctgtagtaagctgtgatcatgccaccgctctccagcctggactacagagtgagaccttgtctcaaaggaagaaaatgattacaaaataaataaagttttaataagttttaaaaaagaaaaaagaaaacaaagaattttgtggctacaggcagttaagggtctctgggctgatgggattgctcctgggattgcagtcaagtagagatttagctgggccacatggttgctagctgggtatgcagtggggtctgcagttggtggttctagtaccagagtcctaggcaggtgtggatcctgcatggtgtctgggccaatagaattgcttccaggaccttggtcagtgggactggtgttgggacaaggatccacttcaaggtctgcagttgagtacacagacagcagccctgttaccaggtgtgtgaatgcacatgactcccaccagttccctgggccatctcctgctgggttactgggtaggtcactaaacaggcaggattggctctggaatgtggctgagagaggctagaaccaagtcacagggctgcttcagggtccaccgctgggactgacatctgcagttctgcctctggaaatatggataggtgtgcctcctgctgggttcctgtatggtcatgactgctcccagaccatggctgacaggtctttttcagggatggtttctgttagtttattttttcccttgaatgggccatactttcctgtttctttgtatgccttctgatttcttgttgaaaactggacattcaaatgtaataatgtaataactctgtatatcagatgctcccctttcctcaaggctttctattatttatttacttgtttatttaattgttgtaggctgtctctgtgctgagaatcaccctgaggtgtaaattcagtcttctcaggtctttactaagcctgagtcccttcccctgggcatgtgtggtgactttctaatttcccccatatgtatggttgcttttgagtgtactatggctggctcccaaaaaagggaaaaagagaaaaatgagagagaaaggcactgaccctttaaatctcctggaaatcacatcagtgggggtgggtggatgggaggtgaggttgtttgtttgtttgtttgtttgtttgtttgagacagagtcttgctctatcacccaggctggagtgcagtggcatgatcttggctcactgcaacctccaggaggtgaggctttcaacagtagtgggaggtgtaacaacaatggctgctaattcattttctgcaattctgtgatcagaagcagtgatcagtgatccaagcacagatccctgatactggaagatagagttctttttgcctactctgctcctgcaagttgtgtgcaagctgctccaggaacatgcgcacggctgtttgccatagggctgaaaagtcagggatggggaactgctactgtgctaagagcttaaattgactgaaattaactgcaactcaccatttaggcttcccctggaaattgcaagcctttgacagactccagagttccaaaatagttatgtcagacagattatgtcagtgtaactgttatttctgtggggaggtggattcctggtgcttcctactccaccaccttcccagaatcctcctctagtcaacacttttgtttttcacagagtttcactctgttgcccaagatggagtgcagtggttcaattatagctcattgcagcctgcaactcctgggctcaagtgatcctcccacctcagcttcctgagtagctgggactacaggcaaatgccaccacacccagctaattttttattttttgtagagacagggtctcatgatgctgcccaggctggtgtcaagtgatcctcctgccttggccttgcaaagcactgagattacaagtgggagtcgccatgcctggccttagtcaactaattttttttttatgaagtacaaagccatttcaatggagaaagtattgtctttttaataaaggatgctggatgttctcacttgtaagtgggagctgaacaatgaggatacatggacacggggagggaaagagcatacactggggcctgtgctgggggatgcggggagagggagagcatcaggaaaaatagctaatgcatgctgggcttaatacctaggtgatgggttgataggtgcatcaaactaccatggcacacatttacctatgtaacaagactgcacagcctgcacatgtatcccggaacttaaaataaaataaaataaaaataaatgatgcttgaacaatggactatccatatacaaaacaaaacaaaaaacaaggcaaacttcaacttaacctaacactttacatgaaaatcaattcaaatagaccatagacctattggtaaaatataaaattataaaacttctagaagaaaacataggaggaaatctttgtgaccttaggttaggcaaagagttttagacatgatacccaaagcatgatccataacagaaaatactgatacattggacattataaaaatcaattacaagtacagaaacagtctgcagaaaaaggttaaattcagagtatctgctcctggaatggttcatgttcttgttccctcgaatctggatggacaatctagtgtttgcctctaaggacatgccagtctgccaacaaagcacttaacatctagtgtatctgggcagtcagaagagaccaaagctgtaagtcagtaatcaccagcaactgttgtaggagcactgtgctgggaggagagaaacctgtaaaatacacagcaacactgagcagaatgacagaaatgctgtgggaaaactgaggaaggaggagcaaagggtctgaaaaaggcttcccagtggggcaggcatctgaggtgagtcttgaaagataagctgaatgttgacaggcaaaaatagacaaacacagatgtgagaggttcaggcaacactcccccacccattataattccaagaaaataaaaggaatacccatcactgttacaattatgcttacaagtgcattcagaagaggggcagttcacccagttggaaaggaaatagagttttccagatggcgatgccaaagcttagtcttgcagggtaagcaggaattagcaaaagtaaaggaaaggcaagcctcagtaaagaccctgaactcggaagcccatgctggatcaacaagagagcgaatactccctgattgctcgacgtttagagaggctgggaaccggacttgttttacaggcaagtggggccctgtcatagagaacttggaaagacacgctatagagtggagccctgatcctgaacatcttggagatccaggaaagattcctaaggaggatggtgacattttttttctttctttctttcaacagggtctttctctgttgcctgggctggagtgcagtagcacggtcatggctcactgccacctcagtctctcaggctcaagccattctcctgcctcagcctcccaagtagctgggaccacaggtgtgcaccaccatgctcactaattttttgtattttttgtagagatgggaactcactatgttgcccaggctggtctcgaactcctgggttcaagcgatccacccatctcagcctcccacagtgctgggattaaaggtgtgagccactgcgcctggctgatggtgatatatttcttaatccatggccctttgggaagacgaccttggaggcaaactggattagccatccacatctcagagacaggagttcatcatgatgtaaaatatgagaaacctgagtgaaagaaaaacagcagtaaagagacaggagacattagagaagtaggtttgaagtcagaagtgaagaggatcaaaaagttattgatgatgcatctgagagggccacaacaatggctgctgtttcattttctgaaacttcgtaatcagaagcagtgatcagtgatagtagcacagatccctcatattggaacaatgcaaaggaaaataattcaaaggaaagttaaagtacaccttagcttggatactgcaagtactatttatcaactttcacagccacagagtggtaacactttctttagagtgacacagtaggagcaccatcatattggacaaacactgccattttaagttccagctgcctttccagctttgtgcatttcaaggaaataatttctcttctaacaacaagcagccagaaagagcagacagtaaaacacagataagacagcttgggcacagagggaggagcgggggaagtctcttgagtaactgccaaacttcaccctcatacaatgggccccagtaaaacagtgggccttaataagcacattcctttcccttcaggtgcactaagataaggaagctaaaagcagaccaggggcggggaggccggggtggtgtatgcctgcggctgcaggaagatgtatgggaacagacacaaaactctccctcccagataagcacagcaaagagacacagacaatccaagcctctgataaactctcccaccctgaatccttaaaaactcttcgtctgacaacagcaaaaagagaaaatttcaggccagtatccctgatgaacatcaatgcaaaaatcctcaataaaatactggcaaaccaaatccagcagcacatcaaaaagcttatccaccatgatcaagtcagcttcatccctgggatgcaaatctggttcaacatacgcaaatcaataaacgtaatccatcacataaactgaaccaatgacaaaaaccacatgattatctcaatagatgcagaaaaggcctttgatagaattcaacactcctccatgccaaaaactctcaataaactaggtattgatggaacatatctcaaaataatgagctatttatgacaaatccatagccaatatcatactgaatgggcaaaagctggaagcattccctttggaaactggcacaagacaaggacgccctctctcactgctcctattcgacatagtattggaagctctggccagggcaattaggcaagagaaggaaataaagggtattcaaataggatgaaaataagtcagattgtctctgtttgcagatgacacgattgtatatttagaaaaccccatcatctcagcttaaaaactccttaagctgataagcaacttcagcaaagtctcaggatacaaaatcaatgtgcaaaaatcacaagcattcctatacaccaacaatagacaagcagagagccaaaccatgagtgaaccccattcacaattgccacaaagagaatataatacctaggaacacaacttacaagggacgtgaaggacctcttcaaggagaactacaaaccactgctcaagaaagtaagagaggacacaaacaaatggaaaaaaattccatgctcgtggataggaagaatcaatatcatgaaaatggccatactgcccaaagtaatttatagatccaatgctattcccatcaaattaccattgatgttcttcacagaactagaaaaaactagtttaaatttcatatggaaccaaaaaagagccagtatagccaagactatcctaagcaaaaagagcaaagctggaggcattacactccttgacttcaaactatactacaagcttacagtaaccaaaacaggatggtactggcatcaaaacagatatatagacaaatggaacaagacagaggcctcagaaatgacaccacacatctacaaccatctgatctttgacaaacctggcaaaaacaagcaatggggaaaggattccccatttaataaatggtgctggaaaaactggctagccatatgcagaaaacagaaactggactccttccttacaccttatataaaaattaactcaaggaggattaaagacttaaatgtaagacttaaaaccataaaaaccctagaagaaaacctaggcaataccattcaggacataggcatgggcaaagacttcatgaccaaaacaccaaaagcaattgcaaaaaaatgctaaaattgacaaatgggatctaattaaactaaagagcttctgcacagcaaaaaaaactatcatcggggtgaacaagcaacctacagaatgggagaaactttttgcaatctatccgtctgacaaaggtctaatatccagaatctacaaggaacttaaacaaatttacaagaaaaaaacaaacaaccccatcaaaaagtgggcaaaggatatgaacagacacttctcaaaagaagacatttatgtggccaacaaacatgaaaaaaagctcatcaccactggtcattagagaaatgcaaatcaaaaccacagtgagataccacctcatgccagttagaatggcaatcattaaaaagtcaggaaacaatagatgctggcgaggatggagaaataggaatgcttttacactgttggtgggagtgtaaattagttcaactattgtggaagacagtttggtgattcctcaaggtctagaaccagaaataccccttgacctagcaatcccattacggggtatatatccaaaggattataaatcattctactataaagacacatgcacacgtatgtttattgcagcactatttacaatagcaaagacttggaaccaacccaaatgcccatcaacgatagactggataaagaaaatgtggcatgtatgcaccatggaatactatgcagccataaaaaagaatgagttcatgtcctttgcagggacatggatgaagctggaaccataattctcagcaaactaaaacaagaacagaaaaccaaacactgcatggtctcactataagtgggaggtgaacaacaagaacacatggacacagggaggggaacatcacacactggggcctatcagggggtggggggtaaggggagggagagcattaggacaaatacctaatgcctgcagggcttaaagcctagatgatgggttgataggtgcagtaaaccaccatggcacatgtatacctatgtaaaaaacctgcacgttctgcacatgtaccccagaacttaaagtaaaataaaaaaaaagcaattcttttctatttgttttttgtaaaggccatgatgaacccttctttgtaagcatgtagactttttatcataaacattgaaagaaaattgtcctatgtacggccttgtagtcttagttcctgaataaaaataaaacaaaatgaaaaaataaaaaataaattaaaaaaactctcagtctgtaagagagagtacctctgtcctaactcagccagaagcccctctcaggtttattttccaaagtaaacctgtctttaactgctgagccgcttttcatgtttctttcctctttctttaattcttacatagagctcacagtgtacttctgagttcagcttggatttctcacttcatgctccaatccctaaactgagtttgacacaagctgtgaagatttagatttagctggggacgctgtcattagacaccaggcttgaatgagggaaaatagcttcttaacaaagatcttaacattttttgaatgttcactttgtccatggttagttaaatgtaactttagtgtaaattatagcatttatttgcttttatctctaggaaataatatggagccacatagattacagtaatttgccattttgcaaaaacaccagaaggttagagtccctgatatatttctttaatcaccaattgctactggacacctcccttgtgccaggcagtaaactgggcactaggcatctgacagtgatgaagaccgacattgtcccttccctcatttctagtggggaagacagacacaagacagttgtaagaggttcaggcaacacccatattttcttcctaatttcaagattaaaataaaatgaacagcccttgctatattataattaatccacaagttcattcagaagagaggccagacacccagatggcaaagaagaaaagagagcttcccagacagagatgccaaggcagcggcttgaagggtcagtgggaattagtggagcagtatggttataatcttccacaatgataatatatttttgctattttaccatttgttctaatatattttctttgtgtttattttacatcattttcttaagtgtatataagattagaatttttacattcattgtgaattgaatcattatggaagggccctctcaattccaatgaatactttttgtcttagtcttttcagtttgctagtaatatcactgaccttgctttattttgattagcatgggcctggcaaattttcttccatccctttatttcaaacttttctgtattcttatgatttgctaggtttggcataaacagtatatgactggatttgtcaatttttacacaaaatgacaaccattaactggagcatttactccattaacaactttttttggggtctcttttgtaatttgaattaaagcaattgctattcattttttttaactctctcttataagcaccaaattttatttatttatttatttttattttttattttttgaggcggagtctccctctgccacccaggctggagtgcaatggtgtgttctcaactcactgcaacctctgcctcccaggttcaagcgattctcctggctcagtttcccaccccgagtagctgggattacaggcgcccaccaccacacccggctaattttttttttttttttttgtatttttagtagagatggagtttca[131 bp omitted]aaatttttttattttatcttattttaagttccaggatacacacgaaggatgtgcaggtttgttacataggtaaacgtgtgccatggtggtttgctgcacctatcaacccatcacctaggtattaagcctcacgagcattagctatttatcgtgatgataagcaccaaactttaatatgtaagtcaattttgggggaaggaaacatcatcaagaacttccttctgaaacaaaacaatgatgttcattccttcaaacatccaaattgaaggtgtaccaaaatgaaaacaaaaaaagtccacagagaaataaaaaggaacacaaatcacattccagggggttagtgcatttagcagtcttagctgtgctgtctaaccatccttcaactgactttcaaaaaaaaaaccctatactcatcaaaatatacattttccatttgctgttttaaaattaaaaataataattgaaaaaggaaaactctaaggaagtcacaattaattgcgtgactcattttgatgtcatgtatagcatatggaggtcaggaaggctatttgcagcacacaggattagaggatatttgtcttcgaggtttagctttcttccaaatggtgtaaaatacccacaattccaagtatgaagagacacggactatttcctttgagaattccaaaggacaatacaggcaccccagctgttcttcatagagagacagggcttccgtcagattgacagagttccccttgtgtaaaatatttcacatcttgtttcaatactttcattgagaggtcaggaatcagtctgagaaactcccatgtggaatcttctggagacatggagattggaacagctatcaaatcattaatcacataatcaaattatctcccttctttggcataccttttcagtactggaatgcagtactgaacctcatatagcagtctcctttaagattatctaagacatcaccacaagtttttcacatatatttcctacatccatcaatcaccatttcgtcaatctctatcatagtgaccatctttagttttagttcggctatttcacacaatatgcccccatctcggcctcccagaatgagtacatctttgccgatgcaaactttgccactgcccatgatggcccaggtatatgtcaaatcactctatgccaaattaacattcccactaaggatgagaatatttccaaattgcttcgagtgtagaattttaatgttctgataaggtgaatcttcatcatataccacttcatctatgttgtattcaaccaggagtccatctgcggtgggccagtatctgtcgatggctcctcctggaactataggtggtaattgcctcatctgccaactactgtcctgactcaattctttcattctttcttctcctttgttcaaaagactgtcgatctcttctttgccttgtgcatcaccatcgtaactctgaaggtccaataactccaatctatgtgagtaaattctcaaattggcaaagctgccgtttttttgtgtgtgtgcaggttgctaaacagcggtgtggtcctgcccggtgtccaccggttctgccatcccctgctcctggaaaatggactggagcccttttagaatggtctcgccatcagctttggcgctgagcatgaagtcgagtgtgctgtgccatgccgctgccatagtgaggcgagaccctgagccatgcctggggaaggcggccgtgggagactgaggggccgcgcagcatgtcaggcttccgccccattaacaactttttaaaaagttactgatcatgtaataaaggatgaacttcaaatgtgaatttattcctactttcatacatttcgctattttcctgcacttttaataaatcttttcctagtttcctgactttaaaaaaatgatgtgatttttgtttgttttttctcattgcctaccttataattaaaataatagcagatagtctgtaatcccagctacttgggaggctgaggtgaaagaatcgcttgagcccaggaattcgaggctgcagtgagctttgattgcaccactgcactccatcctgggtgacagagtg[211 bp omitted]gaggcaggagaatggcgtgaacccaggaggcggagcttgcagcgagccgagatcgcgccactgcactccaacctgggcgacagagcgagacaccgtctcaaaataataataataataataataataataataataataataattttaatataaatagatagtaaaatagtgataatattaaattattcaaaataattggaaattataagaggagcaattttcttgttatatatgatactgcaatgatcaatcacctacaaaatgtaatgcatgagtccaacaggacccaaagagggtaacaatagacattggggtctacttgacggtggagggtgggaggagggtaaggattgaaaaactccctgtcaggtactatattcactatctgggtgatgaaatcttttgtactccaaaccccagcaactctcaatttatccatataacaaacctgcacatggacccctgaacctaaaataaaagttggaagaaaaaaaataaaaataagccaaaacaaaatgtgggaactgtgcacacatggctgtactgtttctctgtaactatgctcttgaacttgggtggtacaacagctccgtccaagtgttgagcaagcccgaattggacacatttagaaaggggcgggacaagggtgcttcccgaagcttctctttcgcagctttttggctgcacctcacacgaggctccgtggttcagcacctacttgatgctgaggtattttgcaagagctttgatgagagactgagtttcatgattggagagtggatgtaggatctttgaaggaaatttgggggttgataatggaggtttttggaatcacaatagggacttgctgtaagttgagttgaatgctcccagtcagatcctctgatgggtaatttgtttccatttttcttcttttctcatattaagatgagaaaagaactttaagatggcttaaagttccatctaagacaataagttgagtattattgttttcataatagttaagtgttttctaatttctttttaccaagagttatttatatgtgtttccaattaacaaaagctaagccttttattgatttctaatgcaccttatctgtgtgctgtgtggtgcttattcatcggaatgtgtttagagtccctttaagactaagttcaaggtccatttttattaatattgtatctctagcttgaagatagtatgagttctccaactgatactgttttgttcaagatgcgtattggtcctgtgtgtgttcttgtttccttaattgccgagagtagtgacttgtttgcatgtgttgatatatatgatgcacacagaaatatgtacatatgtacgtatatattttgagatggaatctcgccgtgtcgcccaggctggagtgcggtggtgcgatctcgcctggagtgcagtggcgcgatcgtggctcactgcagcctctacctcctgggctcaagagatcctcctgccttggctttctgagtagctaggaccataggcgcgcgccactacacctggctaatattttttaaaatttttttctagagatgagatctcgcgatgttgcctcaggctggtctcgatctcctgggccgcaaaagtatatttgtatatttatgcattttatgtggcgatattgggcacaggtaggagtacttttcagaataaagactgtaaaatttcgctaggtgggtgggtcagggccggtaggccccgatgtggcctgtgcaggtagggaggagggtcagggcttggcgtcttaacatgtttcagcgggctgtgaggtgaggccgcgtcctttctgtcccagaatgcggaggggcttgtggtgctgtaagagtctgggaagggggtggagcctggcaaggggcggggctgggtatgaccggacgccatgtgcactggaggcccacagggcacgaagggtaaggtgagtctgagcgtccctaaacccgtccgcccatccatccaccgtttgatcatccctcaatccatccgcccatccatccaccattcgatcacccattcactcttgccccaggcgcgcaggagtgggtaggcggaacctggggagactagcggaggaggccaggcagtgaggcagactgaatttgtctgaggggcggggccaagtgtgtttgggcaggcagaggtggacttgtctgggtccatcgtgttgggtaagcagggtagcctgtgtgtcttggagggaggggtggatcaggctgagcagagcaaatctgaaggggtggcacccagattttctgggcggataggcaggccgttatgcatggaggtaggcaagttgggggcagatgtgtccaggtggaccaaccaagtgtgtctggataagggataaggtgggcaggcaggaccagatggtatcagtcattcccaggcaggcagggcctagtgtgtccagcaggtgcagttgccccaggctagattggcctgagggtgaggccaggagtgttggggaagggtggtttttccctacccacttagggctgaccaacagccctctttctaagagcatgggaatcctactagtaatctctggcccctggtgagtccaggacacagggtagacagggagtcgggctgatgctgagggtctgcccctcagaccttgcctgtaacacccccagagaccttgctgtggtcccactggacactggccacttgacagctgcctcaaacgcagaagtccgggctagcccagaagtaccagatggcagtggtgccactggcagtaagggaggcacctgggcaacagccacacctcagctgttgtctgaagaggacctgccttggcactgtgacctgtaccaggacacttgcagaggggatttttggcaatcagagcctggcaagtgtgagggagggccctggggtagaaggttggggacaatgagggcagtgaggttcagcagtgaggtgacaggaggcagggagtatccaaagaccactttgagaaaacagttgtgtggagtgtgtcagtatttcctgatctgcagccttgggtgagtgacatcaagaagctctagctcatggatcccacaggcagaagcaggcaatgaatgtgaagcacatgaagagtttgaagaaaaaggtagagcagaaggtgacgaattgaatggggagcatgaaggcaggtcgggggtggaatgcagggcaggggtgcaggattgggggttgatatcaaccctcctgatcctgccctgaccactcttgtcctgaagaaggagaagcagcagacgcagaaaaggaagcacacaggcaagtggaagcatccggagcatgtcaaggacccagcctcaccacggcagtgcctgggacccggctgtgtgtatcccacctggccaggctccaagtactgttcagatgactgtggcatgaggctggcaggtgcgtgagtgcacctcgaggttaagggacaaaggcaaagtaaggtgtgatctatgccatctgtaattccactcagccacccacccatccaccgtcatagtcacccactcactgaactgcccatccacattacatccaccaggatgctcatccacccttatagccactcatccacctgctcattcaccctcatagccactcacccacctgctcatccacccttatagccactcacccacctgcccctccacccatccacccacccgtccactgttcaaccacccattcaccaacgtgcactcatccaccactcagtaccctatagagtcaccatttggtagctcatctttctcattcctctgatgtccccatctacccatttcatttcttgctctctcttctttcagccacatcaataacatccttccccagcacatccagcagtggcaaaggagcccctgcattgccaatgagcatggcaagaaaatgctcgagcacatccaccataagcaacagaacacctatacttgcctgaaggacatggagcaccatttccatgaacttgaggccatcattctgcatggcaaacagcaggctgtgtgcacggattactaggcgagagggcattggcgaggtagagcttaaaggtaccgggcctctggtcctgtcctccccatcctgtactgcttccctggtccctccattgtcctgtgcagagcaacaaaggtgaaaagggcagcaaagacctgcagatcttttgcgcctcctgcaggcggcccatctctaagcgtgtcacctttcaccacatggagcactgctttgccaaggttggaacattggctgggagtcagatgggacgagggtgtttttggttgggtggggtggcacatgggtggggtccatgtggtgggggcagatttggcgcctggatatttgtcataggaggaatgcaacacacatccatggcttcccctgtgtgtgctcttcccccatgcccagtatgaaagccaaggtcagggcattaaccagtgatgaaggggacactggctgtgcagacgggagcatagggtctgcaggggacaacagacctggtgtttggagctttattgtaggaggacatgcagcatatgtccacagttcctcccatttgtgctctttcttctccagtatgagtgccaattgcccgttgggtccctgtaccctacttgtattgaaaggtgagtgtgggggctagtaagggtcgaaggcattacgtggacagggtcagaagcaaggttgagcaaggtcaggggcaggatgtgggtgggctcagaggcagaggcgggtgtaattagaggcatggtatgggtggggtctgggacaaggtacaggtagggttctggggtgggacctcactcctcctgactcttagcacctcacttttccaccccccatccagggccacatggctcttctgtgatgtctacaatctgaaaagtaagaggtactgtaagcgcctccaggtgctgtgtcctgagcactcttgggaccccaaggtgagacccttccttacctcatcaccctccattcctccaatcctccctgcctgactgccctcctcatctcctcagcaactcctgtgtgtcctccttcccttcccgaccaccccacattccatgctcattgctgcctctcaccctctcttcttccttttctctctacctggctgtctgtgttcatgacctccttgcccgaccaccttctgggtggtcctgcccctcctcactgcataagcaccccctaattctgctcctcttcttgctcaaccatcctcccttcctgccccaccccctgcctggccaactccctcttccctcctccttgtgtggcgccctcaacttctcttcctcactttctgactttcctccattctgatcattctctctgcctgactgtccccgattctattttctgcctgtcatctacatcctttcttcctccctgtttgactgctccccattctctccctccaccctcctctccttcacctcagccctcacctcccctctgcctcaacaagccccactcatctacttctcctccttggaccaccctcaaccctcccctcctctgccggactgctttccagccttccagctctccagctctccctggcccacctgccctccagccatccctccttctgttggatctctttctgtgcttctgttctttctgcctgatcacctgcattcttccatccctgcttagtctacctcattcctctatcctctatgcctgatcacccgctatttgtcctctcttctctgaattcctctcttcctcctgcctgatcactccccatccctctcctctctgtcctccatctccctattgttcccctgtgcctgatcattccccagggcttcgctccttcataactcatcctcctttgttcttcaccatagatgtcaaaggatgaggtgggtggttgtccgctcgtgcacaatgtctttgagttcacgggtaatttttgttgcctccccaaatgcctgtgcaaccaccactacagctgggagaagctgaggcgtgccgtggacctggagtgcatgcaggctgttaggtgccatgccgagggggctgagggatggggtaggatcctggactccctctcgcatattcaggtcccacagttgcacaagctggaacagctgtttgagcaggagcagaaggtgcgcacgtctatgatgaaccgggtggggctgctggctctgatgctgcacgggacgatccagcacgacccgttcaccagtgacctgtgctccagggtggacatttaagccttgctggacctaggtcccgtattccacactctgtgtaaaggtgacacctcatgaatctctcctcccacatctgttgctccatccatctttttctttcttttttttttttttttttttttgagacggagtcttgctctgtcgcccaggctggagtgcagtggtgcgatctcggctcactgcaagctccgcctcctgggttcacgccattctcctgcctcagcctcccgaatagctgggactataggcgctcaccac[187 bp omitted]tgcttctctgtccaccacttggtctcttgtctctctgtctaccactccttggtggtggtcagggggattgtttaaaattccccattcccatccattcctccatccctttccctttcttccctgaacctgggtgaggccaagggatctgccctgccgttacatccactgtctagagttttcttcaccgactttggaagaacaaggattttgatatctcatgatgttccctaaacctgtctctctggctgcaaacccaattccaaacctccaatagtcggtgggtgacaggcctcgcctgtcatgaccatcatgcccccacacgcacccatcttgtcccattcctgaccatcccacgaggtccttgccctgtcagccttggcccatctcagtccaaccctagtctgtcctgcctttcacttctgggccccctccccccaccaccctgctctgagtgtgccctgtcctttccagcctgtcctgtcacacctatttcacacctgtaggtttgccagaaggtgacttctgccacatctgcctttgccagcccctagccaggccttctgtgccattggaggtgcgtccagtagtgttgcttgtgggtgctggtatgtctccaatgacagacctgaacgacctttcctattttttttcctatgctcactgattccttatgatttttttttgttgttgttgtttttaagacggagtctcgccctgttgcccaggctggagtgtggtggcccgatcttggctcactgcaacctctgcctccagggttcaagtgattctcctgcctcagcctcctgagtagctgggattacagatgcgcacctggcatttttttgtatttttagtagagatggggttttaccatgttggccaggctggtctcgaactcctgacctcaggtgatccgcctgcctcggcctcccaaagtgctgggatgacaggcgtgagccaccacacccagcccttatgatttttttttaatctgcttttataattactctcctcccaggaactcatatagttctaaatgtttaagtgtgttgctctagactttatacctcatattccagtacaactactttacattactacttgtctggtacaatatctcctttctcattactaatattgtgtttctttcttttttttcaatttgatcagatttcccagatcagctttttatttatttataggtcctaattttatatttattttatttatataaacttctatttgtattatttatcacttcttgactttttgttctgtatttttattttacatttttttgtttaattttgctgttctttttctaatttcctaagtcatgttcccaactcgaccattttggggcttccagttttttgtttttttttttgatagtaaagtatttgagattatacactttcctctacatgtagctacgtttccaacactctggtatggaaggtgaaactacaaaattgacttctcattttgatcctaggtattgaagaaagcttcttaggttcttactggttaagatagtttagtggtcttttttttatttttatgtaattatgtttttttattatggtcagagaatgtagcctgcagaatatgaatttgtaaatgttattcaatattttctctgtggcctaggtatgtgacataattttgtaaaactttcatggatataagagaagaaactatattctctgttagatattaggacttggtggggacttttcaatctagttggattatttattttttgtctttctgtctacttcagctgttatattatcaaaaggtagaataaatctaccttttaaaacaaatttcttctgtggttttgtgttttttggggagagatgaatcctaaagtatatatcttagaccatttcacaccatgtcacgtattttcttttttttttttcttttgaaatggagtcccgctctgtcacacaggctggagtgcagtgacctgatcttggctcactgcaacctctgcctcccaggttcaagcaattctcctgcctcagcctcctaagtagctgggattacaggcatgtgccaccacacctggctagtttttgtatttttagtagagatgtggtttcgccaaattggccaggctggtctcaaactcctgacctctagtgatctgcccgcctcagccttccaaagtgctgggattacaggtgtgagtcactgtgcccggccagtttctgttcatttttgtccctactgttttcctcattagtttggaaagttttacttttattaattgtcccattatatacttttcccatttccaacaggcatgatttatttcctttactattttatccgaacataaccggaccttattttatagaaaaagatgaatagtattactttcttatttttctagaaaaatttaagctgtgtatttaaagactatatttttcttacaggttgagttaatcctgcttcaagaaatctcacttaacatttttattcaaaatccccagtgacttcatgtattataatttaacttttaactgtatgagtgtgtgctcaggggtgtgtattttacctcaacagtaattgtgaaccattgttttgctctcttattttgcgatctctcttatgatttcatattcatttatttagaatacatccctaagtgttttctttaagcagaataaatcagtgaaacactcttcaaattatttcatgtctgaaactgtcattcttttgccctgaccaaggaatggtttcttgggatggggtacaggattggaattcttatctctccgtggcctatggtaggcgtgtccagtcttttggcttccacgggtcacactggaagaagaagaattgtcttggaccacacatacaatataataatactaacaatagctgatgagctaaaaaaaaaatagcaaaacaaatctcaaaatattttaagaaagtttaccaatttgtgttgggctgcattcaaagatgtcctgggctacatgtggcccatgggccgcagattggacaagattggtctatgggaagtagcttctaagataaccctcagtgatccctgcctcctggaattcatcaccctgtgtaattccctccatttgagtaacttgcttctaaccaatacaataccttaacattgagaggatgccacctttgtggttagatgacaagagatcatagcttctgtcttggtgacaggctctttcccttgttggttttggcaacatgttgggaaggcccatgtagcaaggatagcctccaactatcagaaactgagactttcagtacatcccaacatccccaaagggatagaatcctggaacaaccacataagtgagtttggaagtaagtctttccccagttcagccttcagatgaagccacaacccctggatgacaccttgattgtagccctatgagagactctgaaacagaggacccagctaagccataccaagattcctaacctacagaaaccatgagatgtgtgtgtttttaagcccatcaagtttgtggtaatttataatacagcaatagataactaatacatggtctgtagatgttaaatgacatctgaattcaatttttgtcaatgagatatctgctgctggtcttattcctctcccttgtataaaacttgtttctgcatggaagtgtttaagaatttctcctcatctttggactataagactgtaacctttatctgcaaaacagagagagatttttaaaaaggctgtaatcaaatttggtcattgcaagggttcctgtggtgattaattatttttagcagctttgcaggggaggatcagtgatttagtcatcaccttttactgtacatcagaatcttctgtggagttgagatggaagagatggggggatgtggagggttcatccccatggcctaggggagagggggaggcagctccctgcagggtgtctagggggagatccgagtgggagcagccaccagccatagccagggagatgctatcccccaccccagcacggatccttccctctccattgattctttacagatgtcagctgattctcaccagcactccctttcccccctcctctggggatgtgccgatttctcctctatcttaatttaggtatagaaaaacccttttttctttggaacttagagactggcagggtagtagggccaccacagtctccggggtccttccggctctctctcctcccttcaaagataaataaaatggccccagaaggcaagtgactcgcccaggcctctcaggttggcagtgacagcactagactggagccaggtctcctgactgtgtcttctaccttcacccaccacagctgagatcaactttcccactcagagttcccgttgagattctgtaaactgaggaggacgatgagtgagccaggctctggctgacagctccctcctttcagacttgcctgtggatgctgtcggctctggaagggttcatcctctcaggggctcaggatcatgcagtcaataagcccgtatatattctgaaactctgttgttttagttttgtttattatataaataattatattcctaatattaagttatgcattatgaataaatacaaagaagaaagtaaaaatgacctctaactctgccatctcctaaatataaattctatcaacaatttgatttatttgcttccatatacttttttctgggcatgtgctttggtgcttatgtttgcaagtgatcagtatattcatatgtgcacttttagtttaaatgaaaactggaatcatgttgtttggttaccttgtttttttacgttgtattttaacttaaatatttttccatggcagcatatatttttctaaacaattttaacagctgcaaatagcgtatctttgaatatatcataatttatataaccaatatgctgttaataaatatttatgaaagttggttttggttttaactgttatgaacatcgccgtggtaaaattcctacatttaaatctttgtgcacatacatgattattttctacagatatagttttagaaattgtactcttgggtcagggtgtaaggacaggtgttaataataaatgggctgggcgctgtgctcatgcctgtaacctcagcactttgagaggcagaggtgggtggatcagttgaggtcaggagttgcagaccagcctggtcaacatggtgaaaccatgtctctactaaaaatgcaaaaattagctgggcttggcggcacacacctataatcccag[150 bp omitted]ggtggcacgcgcctataatcccagctacttcggaggctgagacactagaatcactggcaccagggaggcggaggttgcagtgagctgagatcgtgccactgcacgccagcctgtgtgacagaacgagactctgtctcaaaaataaataaaaatacaaaaattagccgggcatggtggcgcacacctgtaatcccagctactccagagg[134 bp omitted]taataataataaatgaattgggaggggacaattgcacacttagtcccaatgagaaatctgcctttttccaaatgccacatgatcaaatcagtcacacatatgcagcttgtgatcacagaggcatggagttctctggctttccatggggtgcagcctcttgtccagcggaagtgtggagatttccagcctgcttaatctgagcaacacaaccttgacttcacagacctatgtccctacccaagaaagtcaggaaataaccacgtttctcatgagttatcgttaattcatgtatttgttgcacccgttgcagttcagcagcttttgtgagcttttaagaatccctgtagtaaaatgtacaagtatagctccataaaaattagatcagagaaaatatagaaagaatggatgaagtcaggaccagaattgatttgggctgtaggcatttgggccctagggttctgcagagtaaaattaaactgccagtttccttctgagcttcctatcagacatagctggaaagaaaatgcagttatttgtaggatttaccttggcctcagggagaaaaatgactacaagggtgaagaaaacattttccagggtaaagatttcctgataattgaatgtaaaccatctcccgccccccttatttttgagacagagtcctgctctgttgtccaggctggagtgcagtggctcgatctcggctcactgcaaactccgcctcccaggctcaagcgattctccagcctcagcctcctgactagccgggattacaggcacgtgccaccatgcctggctaatttttgtattatttatttatttattagagacagagtctcgctctatcacccaggctgcagtgcagtggcaccatctcagctcactgcaaactctgcctcctgggctcaagggattctccagcctcagcctcccaagtagctgggattacaggcatgcaccaccacacccagctaatttttgtatttttttgtagagacagggtttcaccatgttggccaggctggtctcgaacttctgacctcaagtgatccactggccttggcctcccaaagtgctgggattacaggcatgagccactgtgctcggctccaaaacccctttttgatctcattatggattataggtgaggtgaccttatactttatcatccaaattcagaaactttggaaagtgaaagaggtatcattaataatcatgctggaacagcaggtgtaaactggacaggtggtcaacctaatgataaatgcgcaatagagtttgccatggccatcttctggagcagtggttcttccagtgtgttccctggaccaccaccaacagcacctgagatattgttagagatgcaaattcttggaccctatgccagacctacggaatatctaacttttgggtgtgaggctcagcagtctgtgtgctgacaagccctctgggtgattctgatacacgctcaatgttgagaaccactgatttagagctgtcttccaaataagtcaaaggcacagggccagtgcagaactcagcccatcgggttcttcatgtgcacacctctctaattatcttgtttcatctaggtacaaactatcctacatttttatattcctctggagccttttgacacttcttatgccttaaatagttcaaaattaaaggaatattggatcatacaatatgtgttttcagtctggacttaaaactctgtgtgatggccctgctcgtggtcggttcctcaaaaaaaaaaaaaagtctctatttttaacatgttatcctgaagtacaaaatacaacggtaacgtggaatttattctttcaagatacaaaagttagtttatatttatttcctgtatatagaatcccttagtggtgatccattagttcaagtaaaaaatccatgcttttcccatgattgtagtccagcatttgtccttagtttttattaattaattaattaatttatttatttattattacttttgcctcactctgtctcccaggctggagtgcagtggcatgatctgggctcactgcaaactccacctcccgggtttctaacctcctgattctcgtgcctcagcctcccgagtaattgggattacaggtgtttgctaacacgcctggctaatttttgtatttttggtagagatggggtttcgccatgttggccaggctgatctgtatctcctgacctcaggttatccaaccgccttggcctcccaaagtgctgggattacaggcctgagctactgcacccagtctgtccttagatttttaaacttattttgcttccctaacatgagacatagactcctgtccttttgcatagagctatttgcacttccatgatgtcagatactttattttttttattttatttttttttactcccatgcttttgcactttgcctcacatgtttcactttccatgttaagcttccccaacactggcaggcaaacctacttccccatggagaatttatctttccctcttttgtgctctccatgtttc[131 bp omitted]cctctgcctcccaggttccagcgattctccagcctcagcctccgaagtagctgggattatatgtgcgtgccaccatgcctggctaatttttgtagttttgtatttttagtagagatggggttttgccatgttggccagactggtctcgaactcctggcctcaagtgatccacctgccttggcctcccaaactgctgggattacaggtgtgagccaccactgacttccatttaggaagtcaatctcatgttttctgggagagcttgatgcctttgaaatgccctgaaagtgtattagtcagtgttctccagagacacagagccaatagggtatatggatataagaggggatttattatgggaatttgctcacaccattatggaagccaagaagtccccaacatcttctttctgcaagctggagaactagaaaagctgaagctgataatataattcagtttgagtctgaaggcctgagaaccaggggagttgatggtacaactatcagtcctaggccaaaggcttgaaaaatggggtagggggtgaggggatggtgttggtgtaagccctggagtctgaaggcccaagaaccaatagcctcaatgtctgagagcaggagaagatggatgtccacagctcaagcagagagggtgaatttgcccttcctccatttttttgttctattcagtccctcaatggattagatgatgcctgcccacattggtgaggacaaatctttacatagtctgctgattcaaatgttaatgttttctgggaacaccctcacagtcacacttagcaataatgttttaccagctatctgggcatcttagcccagttgagttgatataaaattaaccgtcacagaaggtaactcatcttgaaagttctaaactcccttaactcacttcttctctaaaagaaggtttataacttcaatttttctctatcttgaattggaatgtctacgacttttattatatgtctgcccaaccattgtatgttcagtgttttgggggaagataacctgtctcttctgttttcacaggtccacatacagaaagagaggaattgtgcctcagaagctgtatgtaatggatgacacccaggagcctcatctgcacctggacctaatatggtgataaaattttaggcttggagctgatactgtaatgaggtgagccttttgggaccttggaatggggtgaatgtattttgcatgtgagagggatataaagcattggtggtcagagggaagactctggtggacacacactaaggtgatacatagtgagtcacacaatcttgtataatttcctctccttgggtgcagatagaatctctgtgacttgtttctaacaaatagaatatggcgaaggtgatgggatatcactcccttgatcaggttatattacagtcaaagatgatatgatataactcccatgatttcattacattatctaacactctgctttagtagactggcacaagagattctccttactggcttaatgaggtaagcgtctatattgaggaaacccacatggcaagaaactgcaggcagcctctagaaaccatgggtggcctcttcgatttgaaggtagcttccagctgacaaccagtaagaagccagggccctcagtcatgtagctgcaagaaaataaaatctgccaatgacgtgaatgatcttggaagtggattcttccccagtcaagtttccagatgaaaatatagcctggctgacaccttgtgagatcctgaacagaggacttagttaagctatgtgtgaacttttgacacacagaaactgtgaaataataaaagtgtgttgtcttaagctactaagttcgtgggaatttgttatgcagcaatggaaaactaataggatatctcatgccctatttcattgtttcacattttcctcaatgtctactgtataaagctccattttgtatctgggcttctgattattttgtgtactgcatatgtggacaatatgcatattttcatttttcgttcagttgcttctgttccatgaaatagttcttaactactctagtgtatttttttcacttgtttgattccctagtctgcaaattcttcaaactagagagttttaaaccatatggtatttgatgcttttgtccttttattttaagtaaatccttggtaataagggattatattttacttttcattactgcagcgctaaggacatagaacctatttagaatattgaaggtattaaatatatggaggtagtcagaggagaatattttgttttatttttaaaatgtctggtgagagaaactcaaaggaacataaattatacctgaaaagagaaaacaatggctttaaagccaaaatattaggctttctacaataatcccctccaatataatggaaatctagtaaaaacaattgtttaaaaacaagtggcagagtgtatctgcttttggagtgcaaaaaaatatgttccctgaattcagatatggaagattgagagtaattttcgcacagtggacatttaatttattcttgagcccatataaattttgtattgctggaaataggcatgaaaattaagctttctggagaagaacatgaagttaagattggaattgcaaataaactggattttgaaggcaatttcatgaataatttgtggaatgcaaaatcacctacacagtcattttaaagactgatgactcttgatctcttcatttatgtatgttactgactctgtaggacaagggacttacagatgagtttttcaacccaagagtaaattctttgcaatggacattgtggcaataatctcaatgatgaaaggtgcaacacaggttaaatggaaaattgaaagtggaaaaaataccaaatcaatttttaggaatccaatgcttacgttctctagaataactaaaaatcataacatgtaggagtaaaaatatgaaggtgaaagaagagaggcttttacacaggacagagctaacatctagtatatcaggctcaccaaaaaagggaaaacaaactgcatttaatcagattatgctcagtatctaaaattcatggtggaatacgaaaatggcataatttactcattctataaatattttgtgaaaacttactatgccacatattctatcagaacatcactgtttcccattctgggcaaagatgatacatgaattatggtaattctaagctgctttaccaaacagactccaagataaatacttaaataatgtagaattgtgttgctcttttatgtacttattttatttattattattattactatactttaagttttaggatacatgtgcacaacgtgcaggtttgttacatacgtatacatatgccatgttggtgtgctgcacccattaactcgtcatttagcattaggtatatctcctaatgctatccctcccccctctccccaccccacaacagtccccgatgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtttatcattgttggacacttgggttggttcaagacacataattgtcagattcaccaaagttgaaatgaaggaaaaaatgttaagggcagccagagagaaaggtcgggttacccacaaagggaagcccattagactaacagctggtctctcggcagaaactctacaagccagaagagagtgggggccaatattcaacattcttaaagaaaagaattttcaacccagaatttcatatgtacgtcttttaataatacttgcttcttgtgttccttcagggacccaaatttcttccaagacatcagccctccattctttttttcccttcatagcatgtttttatttatcacataaattcaccattttcaagtatacacttcactatgttgtgcaactgtcaccactatctaagtccagaaaatatccatcatctcaaagggaaaccccaaacctattagaagttagtctcacatgtacacgtatgtttattgcagcactgttcacaacagcaaagacttggaaccaacccagatgcccatcaatgatagactggataaagaaaatgtggcacatatacaccatggaatactatgcagccataaaaaaggatgagttcatgtcctttgcagggacatggataaagctggaaaccatcattctcagcaaactaacacaggaacagaaaaccaaacatcgcatgttctcactcataagtgagaactgaacaatgggaacacatggacgcagggaggggaacatcacacactggggcctacaagggggtggggtgctaggggagggataggattaggagaaatacctaatgtagatgatgtgttgatgggtgcagcaaaccaccatggcatgtgtatacctatgtaacaaacctgcacgttctgcacatgtatcccagaacttaaagtataatacaaaaagaaatattaaaaaaataaaaattaaaaaaaatatatatatacttaactgatattgaaatacccttgaattcctgaaatacaatgctctttgccatagtgtattactctttgttgttgcaattattaataacagtgctgggtttttacttagaatattcattcatatgtataagtaagattggtctatagttttggtttttttcttttgttttgagacagagtctcgctctgttgcccaggctgcagtgcagtggcatgatctcggctcactgcagctccacctcctgggttcgagctgggattacaagcatgcaccaccatgctgggttaatttttttttttttttgagatggagtctcactctgtcgcccaggctggagtgcaatggtgcgatctcagctcactgcaagctctgcctccttgggttcatgccattctcctgcctc[223 bp omitted]catgttgtccaggctggtctcgaactcctgacctcaggtgatctacccgccttggcctcccaaagtgctgggattacaggtgtgagctactgtgcctggcctatggttttgttttgccttgtgtttatcaggttttcatattaatgctgcactggctatatgaaatgattggtgagtttttttttaattgggatactttaaacaacgttggaattatccttcttgcaaccctagtactttttaaattatggatttaaaaaatcactttacactgtcttctttgtaactggtctattgacattttaaatttcttcttgggttagttttggtcatttatgtttttctagaaaattatccattttctctagattttccaatgtgttgctatatcgttgcatgcagcatttcaaagtgaatctttctaccttcatcttattttacctcttggtagcattctacagagttgaagattctacttgtgaatttttttttttttttttgacagagtctcgctctatcgcccaggctggagtgcagtggtgcaatctcggctcactgcaagctctgcctccagggttcacgccattctcctgtgtcagcctcccgagtagctggcactacaggtgcccgccacc[187 bp omitted]gtgatgaatttatatctttagcgtgaccatgcagagaaatgtatgatggatagtaatggaaaattacaggaaatctgaaaatttaataaattatttgttgacaaaaaaaaaagtctcaatttttccctgcttccaccccttgacaaccagtaatttattttctgtctctggatttgccctctggacatttcataaacatggaatcatgcactatgtggccttttgtgtctggattctttcacttaacataatgttttcaaggttcatccatgttgtagcttgtaacagtacttcattcttttttgtggctgaataatattccattttatgaatataccacgttttgtttgtccattcatcagctgatggatagcttcatttttctagtttaatgccaggcatttaaaatttttattttttaatttataaagaaaagaggtttatttttgcccatgtattctgcaggctgtacaggaagcatggtgccagcatctgcttctggtgagggcctccatcaccgttccactcatggcagaaagtgaatgaaagcaagtctgtgcagagatcacacagtgggagagaaagtgagagagaggggaggaagcgccagactctttttaacaaccagctctggtggcaactaacagagtgagaactcattcattgctgccaggacagtaccaagccactcatgagagatccatcctcatgacccaaacacctcccactaggccccacctttaacactggggatcaaagtttaacatgagatttgaatgggtcaaatatccaaactatagcattctgcccctggccccacaaatcccatgttcttctcgtgttgcaaaatataatcatccctccccaacagttaccaagaatcttaactcgttctaccatcaactcaaaagttcaaagttcaaaatctcatctgagact[223 bp omitted]gaggcaggagaatcgcttgaacccaggaggcagaggttgcagtgagccaagattgggccactgcactccagcctgggggacagagcaaggctccatctcaaaaataataataataataaaataaaaataagaaacaagttatttacttccaatatacaatgctggtacaggcattgggtaaattcccattccaaaacggagaaatgggtaacaggctccatgccagtccaaaacccagcaaagcaagcattaagtctttctttacaaagtctttataaaattagagacagggtttttctctgttacccaggctggtgtgcagtggattaacgctgctgagtgcaacctcgaactcctggactagagtgatcctcctgcctcagcttaccaaaatgctgggattacaggcatgagccaccatgcctagagagcattaaataacagtacctggtagattataagtcccagataaatacacagcaaatagtaattgccacataaatatttataataataatgatcatcatgatcatcatcattgtcatatgactcatatttccctgtgttccaattgggtgaacaatatgtgctttctcctccatcctctaactattctttcagttataattactctgtcttttacatttcagaaggggaatttgggcttgaagtcacacagcagtaaattctgaaaaaacttgacttcacagtgagatgcttcctgttagaaaaaattatgatgaccagatggagaaatatcaggaacatccaaacaaaccttgaagtcatatttctttcatcaaaaagaaaacattaaatacaagagagattatgattattactatgttgtaaaagtatttcaagtggttccaaacattgtcctctaacaaacagaccccattaatttgattcatttgtaaagaattggaaacaaaatgtagactcacagagtgataatagaagcagtacctcaaagaaccttgacaagattaactattgactattttcatgtgtagttcattctgtaataaacatgaaaatatttatgcaggagagaaattttaaaatgcaatccatggaaatgaaatccatgtagcgtgtgtattcacaaaactcatagagtgctctacagtgctacaaagcactctgtgagtgtggtgaatacataaaggctccatccagaaggcaacactcaaggtccaacaaagaattcacactggacagaaacctgacaagtgcagtggctgtagaaaagccttcactgggatttcacgtttcaggaaacaccaaatgatttatactgaagagaggcaatgtgaatacgatagtcaagtgcagtggtatgcgcctatagtcctagctacttgggaagctgaggcaagaggatcgcttgagtcaggagttcaagactgcagtgtgccatgataagatcatgcctgtgaacagtcactgcactccagcctgggccacatagtgagaccccatatcttaaaaaaagaatattgtgaatgtggtacaacattcaatcagaaatcaatactaaatatgcatcaaaaaactcacaaggagagaaactttatgtatgtaatgaatgtggtgaggccttcaactggaagtcaaacttcattacccaccagatgattcatgctggagagaaccttaggatgcaatctcgtgggaaattcttaacttccaagccacaactcttatggcagtcagcaagttcacattgaagccaagctatatttatgtaccgaatgtggaagtgctttcaccaaaaaattaagccttctcacacaccagaaaactcatactggagagaaactctgtactgactgagagaggaccttcagacagaggccagagttgattatagatcagaaaattcattctgcagaaaagccttattaatgcagtgtctgtaggaaatcttttgctaggaaatcatgcctccaactgcgtcagcaaattcacacaggagagaaaccctatatatgttctgaatgtgggaaggccttcaccaacagttccacgctggagaaatgctacaaaacttgcatttaagataaaccctacaagtgtagtgactgtgctaagtctccattcagaagtctgttctcattatgtgtggaactatttatactttcgagaaaacgtgtttgtttttgaaaaacgataaagctttctcaggaatcagatctgattgatttatgtggaaaagccttaagtgagaagttgttccttactgtacatgtgggaaataattctcaagggaacctttaagaatgcatggcaggaaggggggaaattccttttaaaaatattttttattttattttttggtagagaaggggtctccctacgttgaccaggctggtcttgaatgcctgggctcaagcaatccttctgcctcggcctcccaagcactgggattacaggtgtgagccaccatgcccggccaggaaatttcttatttgcaccagccttattgattatcacaatcttcatgttgacaatttaatgcattaggaaagctttcttgtaaaatttttcaaaacagatttttggtagaaaagtttgtgggaaattatataaataataatgctatacaccatggaaagttatgcattttaaagtgtggaaaaaatgaatgataggttcacaatacagttctgagggaaacatgttcttaaatccataaagattatgttgcaaagtaaaaggagtaacaggaagtataaatgtattgttatttttaaaatctaaagtaactgcatttcacattctctagcaacatattctaaaataaaaatcatgacactaatttattcatctatacatacacaatagtgtatgtttagtttttagtaaatgcatgaacatgatctaatcatagatactggcttatgtaatgtatcttttatcttccttgtttacttttccaccccctctgtcccatttcattgcatcttcacccacatcagcaaccccctagagatatccatctagtgtgatctgttttatttttgtccctgtgcttataattatatatacacacataaattatctctacatacttatacttgtataggagttcatttcttctctgttttagaaaagtaacattgttattcccacatccctgcatcttcgttttttgcttaacacctcttttaatggtattgaattttcccaaccattactcatgtgtcagttagtcaccaggtaatcaacacgagagctcataggcatgtacctataagtgttcattctcacagatttacagttcatctggggttctgttcatccaagctaggcttggttgggtggctctatttaaggttgtggtagctgtggcatctctattcttcaactctctcagtgtggggcttgagttttaggggcagaggttccccatgggaatattcttctcacagctatggcagaaacataaggggacatgggaaaactatggggtgactaatgaggctctgtggtatgggttatggagggattctgtgtggtcagtgatgaggaaatctgtgtagttaataactaaggatctttgcaatcagtgatggggttgtgtacatcttaaagcctagacctagagctgacacactcactctcacatgctcttggccaaagtaagtcacatgtgcaagtccaagttgaagagacagggaagtatactctgctcacgtgagggcaaggcaaggatgtagatgcaggaagggctgaaaggttggggccaatgacttcatctatcacgaaacaatggttttttttttttcttttaacaatttctctactttttttttccacccaaaacaatgttgtcaataaataccatagagagagggagtagagcataagtaggtgtttcagctctggagccagactttctaaaatccatatggtaaaaacacatatgcaagaagaggaggagaaatgagagaggctagcactgcccaactttagattctactacaacccccccctataattaaagcaatgggatactgacacaggaatgggcagacagaccatagactagaaataaaaattccaggcatagacccaagtatatgtagaaattatagtactgtgtatgagaaaagagttcaagacactggggcaggctgggcacggtggctcacacctgtaatcccagcactttgggacgctgaggagggcggatcacttgaggccaggagtttgagaccaccctggctgacacagcaaaaccccttctctattttttttaatttaatttataaaaagacaccggggcaaagatgtacttttaaataactggatagccgtttagaaaaaaagattaaattggatctatatctcgcaccatacatgagaattgtaagagcccagtaatagaccccaggtagatcataacctttgtcttaaactaaaactgaaaagtgtgtggtcggggaagaagtggggcttagaagataaaacagcctctgatttctttcagctgggaattggccttctcccgacagctaggctttgatgttctgctgttgaacataaacaatttcccagtacaagagataaaaacaggaccaccctgtcagcacagtggaccacagacaaaacaaaaaagaacgccagatgtgctaactctaagtctctcctttctctacaacttaggaagtgtctggcacagtgttaccttttgctcagcaagtcactgatttagatcaggggctccctgctgtggagcagtttgaataaagcatttcttatacttttcagctcagtctcagatttgaaagtttttagatagaataagctgtaaatggatgacagatctaaatgtaaaaatagtgaaattatataggtactagaatataatatacgtgaattcctttctaacagttgtgaggaaaggccttctaaatgacccaaatccagatacctcatagattcgatgtaagaacaaaactgaattaatacacataaagcacttggaagtggagctagtaagtgctccatgaatagtacacctgatccttcatgccagagtttttgttttgtttgtttgagacagggtcttgctctgtcacccaggctggagtccagtgacatgatcatgatttagtgcagtcttgacctccagggctcaagcaatcttcttgcctcagcctcctgaggagctgtgaccagaggtgcataccagcacacccagctaatttatttttatttttattttttgtagagatgggggctcactatgttgcccaggctgacctcgaactcctgggctcaagtgatcctcctgccttggcctcctaaagtatgggaattacaggcgtgagctaccatgcctcacctgttttgtttgttttcgttttcttgtgttgtcatttttgcgtgctgattcatttccagtatctgcaagagcagaatccaaggaaatatagagactaagaaaacaccagttgtccatattagatattaataataactgcttctattttcctttggaggttggggtgtgttctgatagttattaagaggggcttttagaaccctgcctccacttgccaccagtacagttggagtgggctgtgctgtcatagtatcttctcctcattttccctagtattctcatcccagaacagcatgtagcatcctgacaattaccccagtgttatctcctaagctctcattcctggctctttcccatcctcttcttagcaaatggtcccttgacaccattgctatgcactgaggggcacctctgcttctctaaatattgctgcaagctctaggtaccagctccaaagacacttccctccagaaaacctgtccagaggaggaccccacccttgctgcctgctgctctggtataagttcacaactctgctctgtgaggcaggaggtgcctttgtcttctgtatggaatggacaccttccccagataatgatgcccacagtgaagagccaagtgggcacagccatattccctgccctacagcactgcagacaccttttcatttctattgcagtagtgaaagctgtcaaaacaatactaagtaacggtgattatggagcctatcttgttggtttcttcagtggagacgtcttcagtatttttcaattcagtgttctgtttcttgatgactttcagtaaatgatctctattgtatttaaggttttaatattcctgctttggtttgaattttgattgagaatgactgccaatttgtgcccaatgcctactgtatatccattgatataatcatgtgttcccctagggatcatgtatacttgctgtggtactatagtgtcctttctccttgggaccaacctcctcttcaattaatgcgctctgggtctgaaagtggctcaggtctggaaactcgcctctgttgcattgcagtcctatcatcctcaaagcaatcagttagcaaaagtctgtaacagcttttcctattgccagccctgacctagaaaggagagacaccactgaacttagtgatgtcggtgtccctctcacctgaaaattcttaatggcctttgtaaatatgacttctcgtggagtgtaattatccagtttctggtagtgtatccagcaggtccacttccctgcgacttttcatcccttctcccactaactgccatggcaaatctggcatttcaacatcccttagcacagattattgcttgccccatattgcaaggaaccatctcagtggtgaattacatcatttcctgaagtccttgccaagatgttaaatcctgtgtttctcttttacccattcttgtgttcttcccatccaccacctcttgatccaatgccctcagaatccctcttgatcaagcaccctcaaaattctgccccatatgtactcctccggctcttgttggtacatgcagcccaggccttgcatcgcctttgcagtatagcctctttcctcccttttcatgcccagcacatatctgtgggttatcccgtggcttaaccttatttataggtatagtggcaaagaggggaagtgagggtagatcctgatgggggcacagtggaggggctgcagtgtacttcagcataggggtgtgatagtccttaacagggagggatgggccacttctgcaggcttacagtgttcagagatatggtaaccagcatccaagatggaccgtaataacccttgccttctggtattcatgccctagtatagtcccttctcacgctggttagggacttgatcctgtatgaccaattcagtacacttgagtctacgtcatagaaaccactgcagctgtttccttgacctctcagatcattcactctgggggaagccagctgccacactgtgagaacaaccctgtggagagagccatgcggggaagaactgaggctcctggccaataaacagccagtaccaacttgctagccatgtgaatgagctaacttggaagtggacactccaggaccagatggcgttacagatgactttagcctcagccaatatctaatgcaaccacaagagaaaccctaagcaagaactgccgaggcaagtccttgaatttctgacccacagaatatgtaggcataataaatggttgttttacataactaagttttggagaaatttgcaacatagccataataactggaataaaaggaatctggagattcaggattttggaggtcatcaacccagacgtaccctgtgtcaaggttgcttcctttcccagtcagagccctgaccttggcatagaagatttgccttagttgagagtttcactttccttgtactctactgctctgaccaagtcctgagccttgtccttagtgtcctttgcccttccacttcaggacatgaaagcttcttcatatgctgctgccaaggaagccccttgaggcttttacactttgtttcattgcctgttaaccactctgtgccttttattgtcgttttgtagactgtcaattgagctcagcaaaggcaccaaaaacttttagcctgattgttactatttcccccatgtgcatccccctccaccagtagccagcccagttcaccacctgtgagagttttaacaattgaattgtttatttattccaggagctgtttgcactccacctgctactaataatgatgacttctttctcagatgggcagtgggtgatgtagttccagaactccatttcatccacagcttgctgtctcagagcacttctgatactaattgttatgtgttgagttccctaggaagcagaccctgagaaagagtttagagtacaggatgtttattagggagggcccttgggagaaacacctgtgggaaagagtggaaggaagctggagtgaacagaagaagctgagctgtgctgaagaccaaatgacagccttagccaatcctgcagggagctttggagctagaatggctctttgctgtgctgagtttttattccctagacttgatcagacattggatggggactgccccaggaaagggcatgatcttgggcatggtagctccgtgcatctcaggcaattccttaagggatttacagtcctgaatactgtcagctgataactgggaaaccatctttccttgaagagagatctgggtggtaggtcacggtgaccatgggagttgttcaacagacattgggctgaaagcaaatggggtatcttgatgttacaggaatccctgcttaccgggcctctggtttaatcaaatgtgactagagtgagtccattttggagtgagtaactaggcactcacaaggcacctatagggttaatacttaggctctgaaaatagccacattctaagttgaccatcaattataaatacagaatatttacggccatacagagcatctcccaccaagccagcagaatgtccacatgtcctaagcatgcagcccactttgcttaaagataacattaatgagcaagtttaggttgaaggattaatggtcattaataacaccaattgctcctacccatagtgaacacatctgcactttccaagtttaattctagctccttatagtttcttataagtagggacactaacaaaggacaatgctttcctcctcttgctttctgaggacaccctactctgtaacagaatagtttccactaaacttgcttctttcactgtgctctgtgaattgtctctaattctttcctgtgcaagatccaagaacctgctattgaaatctggatcgggaccctcttttctaataacagtgaggcccagtgaaaggacctcatgaggttttccacaaacaccgtgatggaggaaaacgggaagttcagcaaatggtgtgctgaaggaaatagcgggacagcagactgctgggagaaaatggggaaacaatagatgctgttcaggggacagtagggatttgaggacactatatgatctcccaacaccctctgcgccccttcaattttcccccaacataacccctgaaacactttggtttcattgcctgttaacaactctctgccttttattatcattttctagattgtcaattgcgctcagcagatgcacccaatacttttagccttattgtcactagccttattgttacagaataatagtgtgatgggggctaatgatgaactcattgacacaggaattttctctcagcccctttgccagactcgcagcaagggcaccctctctactcagcccgtgccactcaaccccttgtgggagggagcacatgagcaagtgagtgtgggataagctcttttagttctgctgtccacagcccattgaacagcggtgtgttagcagctcagctggctcctggccccgtcatgtggggtggctgccctctgctggcgagggcaaagggccagtgcaacaacctttatgggtacctgcactaggtgggtcctgaaccctagttcagcatccaagaagaatgaggatgtgctatcaaggagtgagcaaggtggggggttttactgagggatgagtgatgaaatagctttctgtggagaggggatacgtgggtggaccccctacctgaaggcaggaaagccccccaaccccccaccctccgctgcaatgtgtctgagtctggggctttcatgggctcagaataggggaggggcaggcaaacaggaacagatgttttcactctggtccaaggttttacctgggactgtcctcagcttgaaggtggggtttcaccagggacccacccctatcttcctaggcatttggctgcctcttgtcgctatcatcattagcctccatcacattattattctgtgactccctactggaccccagcacagtatctgtgaatcaccaacaacagcaagggcaacgtctactgactccatcagcaccccctagaacagcattttctactctacctggccctgatccgtgtcttctgacatccaaatagcctgaatcatcacagtgtccaatgacttcactaggccacagctcagtcacagctgttccgttttgagttttaatcttctttttcagtaggcactctctttgcaacccagggtccctgggttttggagtatgtaaccaaactcaggcctgggccactagttatttgaaagccaaaagctcaaaagccaagctttggtaaaaggaaaggtagctttacttgagaagccagcaacctaggggaggcagtgaactagcattcaaagattcaaagaccaccttaccgagttgtgtctctggatcagggaggtttaagggaaattaggggaaatgatgatcaaaacatttgcacgcgtgcagtctcgagtgggcagttaatcattgctttcttggtcaatgttttgtggccttctgcaggcgctatcagcgtatattcttatcaggctggtcagcatgtcccagagttgttggtcagcgtcttttcttttatctctattgaaggtcatgtttcctgaggctgtttttcctgaataatctacaaactcaagcaaagtaataattatattcaaacaaataaacttttctctaacatggagtcagtactgtgaaaaagtatccatttttaactgttgcaccttgggttcttatttcaaaaagttccatgaagaagatcagccccagcaaaacaaacaaacaaacaaacaaaaacagttggatccagagatgcctgagttagagatgactttggcaactctcctcattggcatacttaaaaccctgctcagggaggagcttatttgccaccttctatgcggaagcatgttcacgactgcacctgtgctgcctttactccacctctacatacaatgactcggctaaccagccccaccaaggcccttgttttcaccttcgttccaggaggtgctgctttgaggaattatccccagtgtcctccttgttgcaagtaataaaatcctcttgttaagtcctccttggttttggtcattggacagtcactgccaagcaatcaaacccactcgtatgagtaacaccttgttgagatgtagcacaaggattagttgggtatgtactcttagcttcctgctggttcctgctttcaccaccctggcaaagagatgtgccaatgcacagaaatacaacttcaccttgactttggggacatctgcaccgcctcattgagtacatgtcaatgtgtaaggtcatctccactgagccttgctgatgcgagggagaggaaaagcaggatctgacacactgcctgttgctgcagggtgggagcagaagctcagctccctattgggccctgctgatggcaagggtggaggaaaacagtgtgtcctctagctgtttcccgccacttcattctgcctcattgatgccatgtgtggcttgattctcaggtcctaactgggatccactgacacccaagtggtggccttgttcagtctcattccttctagatgggccccactgggccccactgacccaaggggtgggaggcaagtggatttctgactggccctgacttttgctgcattgttcagtctttttgataccaggtagagtggaggcccagctcacaccggacctccctgatactaccattgtggaagaattggaggactgcctgctttttccaggcagggggatgtatgtaagatcagatctgcaccccaccttagtgacactaacctggcaggagagtgagagtgccacatgcttccactgggcagaggatgaaatattaactccctgctctgtcccattgacactaccccagcaggggatgagagtgctgccctgtgctttctgcaaggtggtggggtggggatcaggtccccactcatcttgctgaaatgggtggggtcgggtttttctattggtgtttgactggagtaagatgggtactgccaaaaaagtttttctgattttcccttttcactccttgtatagtaaccgcataaatctgttatctgtttaggtttgttctctcacctgtctgtattcctttgcctttggactcgtttgaatttttctgaccatgttatgatctcattaaggcctcaacccaaatagctgctcttgttggcaatggcaacatcaaggccaggacttttttttttttttagacagggtcttactctgtcacccaggctggagtgcagtggcacaatcacagctcactgcagcctcaatctcctgggcacaagagatcctcccacctcaatctctcaagtttctgggactacaggtatgtaccatcatgcccagttaatatttttatttttatgttttgtagagacgaggtctcgctatgttgcccaggttggtcttgaactcctgggctcaagtgatcctcctgccaggcctctcaaagtgctgggattacaggtgtgagcccaatgaggactcttttctaatttgtcataggaattgaactacttcactgcataacatgtgttcagttttggtttggctgcctgacactggggtttggtggtgccatttaaaataccaccagaccccatacagggcttgcattgtctcttctaccatagggttatgtaatcattcagtcatagttagacccctgattagatgacggcttctgctaccaaaatccacatctccacagagtagagtgacagtgaaatatccctgctgaggaccagactgggattttttttgttaaagaagctatctctttaagcacaaagacaaagtcactgcacaacccccaaaatactaaatatcccccttttcttggctaaaatgaatgacttctgcttctttatcaattttagccttatcttcactctatctagtttgccttctctatagataagatttgttgagatactcaatcacagaattgttctactttctgacaactcccaattagagctggtctccacttctttgaacccttcagcaaattgcccaaccaaagctcaagtcctataatatgtccttttaatatcctcttattgagatgctccatggttccccatgatgtgcactctctcctgctacaatgagtaataacccaacttactcaagtatagctatgttcttggtgatctttgactgggggcattgatatcttgtaactcttcggttaaaaattcttgcttttcctgaattttccattggttttctcatctgggatttaatcatgggattgcaagaagccaagtaggtagtctggcatattcccctcaagaaacttggaaagtcaaactacatggatgagaaacaataggttgaaccagcgagaaacagctggttgtgcctatgagatgggaagattctcagagttgtattgagtctgagggagggaagactgttgtaaattacttcagaattaactggtctctgtcaagaggtaggtatgagggggacatgggcttagtactcggcaatgtgtacctccctgttatccttaggaatactatgaacagcaaagacaggtaaggtagattattctctgaggctgagtcatttgcaaactaatctgctattcccttcactggaaaaggggctgcaggtgagcaaccactctttcctctatagcatctactttctcttcatcaatctgaactcactccttaacttgtcctgaaatagcccacatccctgacattttattaattctctttcctggacttgactccagaaagtacctaagagggtaaatactatgtaagacactgtgagtagaactttagactctccacctccacttcttcttcccagtatacccatttaactaactgccctgggaacactgttaatctctgtcccatcatatggactccctgtactgtaccaataaggcccctggttagggggcacattctttccctttcaggcaatcccagaatgcatttacccttaccccgatcatctcatctcttccatgtagcaagccatgctgcaagatcaattggaaattctgcatcaaagtgttgcaagacattaacaaaatttgaaaacgttctgtaatatgtggtttgttcaacagaaaattatggaaaaaaacattgaagaggatcagaattccagtgatactgagtgaggatctccatgaagagctgctcttcttatcttcccagccacaaattaatttccctaagtgtcccaagcagaagtttcatgggaggagaacatttcttaaagccctggctaggttttatcaactaacaagtgcgtgtatacttgtgttagtccatttgcattgctatgaaggaatacctcaggctgggtaatttataaaggaaagagatttaattggcttacagttctgcaggctgtacaggaagcatggcgccagcatttgctcctggtgagggcctcaggaagcttccaattatagcagaagacaaaaggggagcaagcgcatcacatgatgagagcaggagcaggaaagggggaggatggaaatgccatactctttaacaaccaagtctcgcgtgaactcagagtgagaactcattctaccaatgaggagagcaccaaaccgttcacgaggaatccatctccgtgacccaaactcctcccaccaggtcccacctccaacattggaggtcacatttcaacatgagatttggagtacacaaatattcaaaccatatcagtactattacaaattatgtcatattgtcatgtacatctatcaatgattcagctctgagaagccattgtaatacatgtatgtttgattactgtgcagctattctgtacgatagttctgggacttcagatgaccactggaagcagacttctctggtggccacactaggcatcactactacagatatataattccacttttctcccttttacacactcacacatttaaattatacacacacatatacaatattatgtcatcagggctttcactttgaatgaggaagctgcaatattaatctggaacacagctttacattttctgcaatctgtttgcctaggaagaaatctcttcatttaaagattaataataatgatgatgataataataattgttcccaacccacaaagatactacaaaataaaataatggaagaaagaaaaagttatacacacacatacacacacacacacacacacagatcctggcttttggattgagatatgtaaatttttaaatgttaagaaagtatccatcatttccacttttcttgaaggtttttaaatgttcacacagtaaaattgaccttttttgggtctgcatcacagtaaggatacagaacagtttcataacctctaaaagatccctcatactacctctttgtagccaaattcttcctccccaccagttcctgataatgactgatctgtcctcatccctatagttttgtcatttccacaatgttatataaatgagatcatatagtatgtaatctatcatgaatggatgttgaattttataaagatcttttcagtatctatggaaataatcatacaagttttctttttaggctcattaaaaatagtgaattatattaatatgacaactcaaattttaatcacacccccagaatttattagctatatgacattagactggttacttgttctatgttcctcaatgaggatgaaatgagttaatccaggtagagcacttagacttgcctggaacatgaatattatatgagcatttgcaagtataattgctaacgttattacctaatacatttgagattatagagaagaggtttacacacttggaaagtatctcagttatttgttgctacaaaataaattactccaaaacttagtggctaaaaacgacaaccattttatttgttcatgattttataggacagcagctttaacttggctcatttggagggcagagtggttctgctagtcttgtctaatgtcattagtgggactacagtcatctggccgcttgactgggactaaatgttctaagatgggctcactcacaggtctagggtcttggtggggatagctggaaggctggtacttctctccacttaatcttgcctcattcaatagtcttgcccaggtttcctttcatagtagtcccaaggcagcaaaaagatgagaacagaagctgcaaggccacttgaagctcaggctctggaactgacacaatatttccactgtattctattagtcaaaataagtcacaaggaagaccagatacaagggatggggaaattgattccatctcttgatgggaggaattgcaacataatgcagccatatatttcaatctatcagaggggaaatttggagatggactaataataaaggtatagaaaattaaataaacaaactaagccagacagttgttaactccagggaagacaaagagagaaacagaaaaggaatagtaatcacagtatctatattattaaactcaattgtgactacagtttacaaagccataatgataattatcactgaccctaagtctgaccacaattatgatgcatctatattaggaggatggaggcagtagaattatgtatgcgagtgatgtgcatatgggatgagatagagaactacatcttcttccagcaggaattcagtcagtagggaatacttaatattgaaaaatcaaagagcaatctaattatgtttctgacagttatgaaggtaaataccaatagaatccttgaaaagggtaaaaggtggttgcctctgggataagagaatgggatgagaggtggggcagagcaggagacaactattttttgtaacaattcttgtaaaactacttgattatttttatgatatgcacatataattttgataagtctataattttctcaaaaatctaccttaattaaaatgcaaatgatgactgggcatggtggctcatgcctgtaatttcaccactttgggaggctgaggcaggtggatcacttgagttcaggagttcaagaccagcctggccaatatggtgaaaccctgtctccactaaagatacaaaaaattagccaggcatggtggtgtgtgcctgtaatcccagctactcaggaggctgaggcaggagaatcgcttgaacccgggaggcggaggttgcagtgagctgagatcacgccactgcacgccagcctgggcaacagagtgagactctgtctcaaaaaaaaaaaaaaatccaaatgacaaagaagcaagaaatagtcacaaatttatatataagagaaactattatcaatcttactaaggttgttatccttaatatatacaaagctctttaaaaatagataaaccggccgggcttggtggctcaagcctgtaatcccagcactttcggaggc[135 bp omitted]gctgaggcaagagaatctcttgaacctgggaggtggaggttgcagtgagccgagatagcaccactgcactccagcctggtgacagagtgagactccgtctcaaaaaaaaaaaaaaaaggtaagctaagtcaatcaatagaaaaatagatcatcaagggaaaggaaaacaaatttttaaaaaataatgaacagtttaagagttttaaaggtatatttcatttttaaaagtaatggaaattaaataaaaatgggatgctatctctcatagatcaaattaagaaaggtaaaacataataacatctagggttagtcagagtgtgggctaatgggcactgcttatagtagcgtacaacagtgtaggggcaatttggcaaagaatataaaaaagcttaataatgggctatgcccttttctcaaaagttataatctagaaatacatgctaaggaaataaccaaagagagtaatttaaaaaatcacaagcatagtcagcacaattctgttaatcaaggcaggaaataatgaaaaacttaaataaccaacagtaagatcttggttaaaataaaatatataacatctaagggccagatgcagtggctcatgcctgtaatccgagcactttgggaggccgaggcaggcggatcacctgaggtcaggagttcgagatcagcctggccagcatggtgaaaccccatctctactaaaaatacaaaaattagctgggtatgatggcacgtgcctgtaatcccagctattcaggagactgaggtaggagaattgcttgaacctgggaggcagaggttgcagtgagccgagatcataccactgcactccagcttgggcaacagagtgagactctgtctcaaaaaaaaaaaaaaatttatgtaatggaataccatttaaatagcagacaaagaatcattattattgacataaaatatttaatatgaaaattatttttaagtaatcaaaaaagattcaaacatttgcatatagtataaattcatattggtaaaatgtatctacctttccatctataaacatatagaaatgttatatgtagatgataaaattactggtaattcatctttctccatcttgctcatcatttaaaagatatttctggaacacacatattttccttgtttaattagaaaaaaactaaaaacataataaaggtatcctatcaaaaaaatattctcgagggatatccaccaaattgctaagatttgttatttctctgtaaattatgcacttgcaaggttattacatttgtgcagtgggtgggacatgtgaaataagttgaaatcttggttccttttcttttttttcttgtttagtaatataaaaatcatttaaggctcagaatcttcttgttatggccttaattgggtcccagaggtttttaaaagtggtgttcttattatcattgatttctaaactcatttcagtttaaaattcctctttgactgaaaattcactagaagacaattttagacataaaaatatttaaataatatttttccaacttatcatatatattagttatctattgctgtataacaaattatcccaagacttagcagcagcttaaaataactcatatttattattttacatagtttctgtgggtcaggaatccaggcattggctagctgagtgtgtctggctcagtgtctttcatgaaggccgcaatcttatctgaaggcttgactgaggctgaaggattcacttctaggctcactcacatggctactggtgagtctcagaagatctgcttccaagctcacctatgagggcctcttcacaagggtgcctcctgacatggcagctggcttcccccaaggcaagtgatccaagatagagtaagcaagggcacacccaagattttataatatgatcttggaagtgatatcttgtcacttctgccttattttattcattagaagcaagcccctagggccagtctacatgcaagaggagattaaacaagggtgtgaatagcaagaggcagagatgtttagagtctatattagaaaggagcataccatactatattagagaaaaaactcaaggaagaattttaaataattgaaaactgaatcagcagagagatctccaagcaggtagtcaatcactcttgtgaacacacacacacatccatatatattaattacacacacatatatatattcaatgtatatatgtgtaattaaattgtaaggaagaaaatgtgattgtgaatctgaaataaaaactgttacataaggactcttgaaacagaagaaacatgccataagtaaaatataaatagctgggaattaacattttaaaataatatttgaaatattcagaactaaaattgtttaacttgccgagaaaaaatgggaatgaggaggcatctgtctgtgcaggtggagttacaagtttatagaaacatgacagccttagttgtgcttattaagaatggaacatatccacttgaacaatttacagaattaaaaattgctgaatgaacaaggtgggtggaagaagaacatgaacagaaacttgattaagccagtaaaagaaaaagaaagagaaaaacaaagaaaaataaatggtaacaataaaatcaaaggcataaaattagttatttcatcattacattccatctaataggctgagttattctatgagaagatatagatatgaaatcaggataataaaatcaagtacaataatatttatttaatttattattgtttaaaacttttatttaaaattcaggggtacatttgcaggtttgttacataggtaaacttgtgtcatgggggtttgttgtacagattatttcatcactcagttattaagcctagtacccattagttatttttcctgatcgtctccctcctcccactctccaccctccaaaaggccccagtgtatgttgttcccctctatgagcccatgtgttctcatcatttagctcccacataagtgagaatatgcagtatttggctttctgttcctatgttagtttgctaaggataatggtctccagctctatccatgtccctgcaacagatatgatctcattctttttcatagctgcatagtattccatggtgtatgcgtaccacattttttttatgcagcctatcactgatgggcatttgggttgattccatgtctttgttattgtgaatagtgctgcaatgaacatatgcatgcatgtgtctttataatagaatgatttatattcatttgggcacatactcagtaataggattactgggtaaaatgggagttctgtctttaggtctctgaggaattgccacactgtcttccacaatggttgaactaatttgcattcccaccaacagcgtataagcgttcctttttcaccacaaccttgtcaacatctgttattttttgactttttagtgatagccattctggctggtgtgagatagtatctcatagtggttttgatttgcatttctctaatgatcagtgatactgagctttttttatatatgattgttggccacatgtatgtcttcttttgagaagtgtctgttcatgtcctttgcccactttttaatggggttgtttttctcttgtaaatttgtttcagttccttatagatgctggatattagacctttgtcagatacatagtttgcaaaaattttctcccattctgtaggttgtctgtttactctgttgatagtttcttttgcttttacaatagccacaaaaccccccaaatatctaggaatacatctaactatggaggtgaaagatctctacaagaagtacaagacactgatgaaagaaatattagatgacacaaacaaatggaaaaacattccatgctcatggattggaagaatcaatatcattaaaatggccacactatcaaaaacaatctacagattcaaatgtgttcctatcaaactaccaatgtcatttttcacagaattagaaaaaaactattctaaactttatacagaaccaaaaaagagcccaaatagccaaagcaatgttaagcaaaagggacaaagctggaggcattacattacctgacttcaaactaaactataaggctacagtaatcaaaacagcctgggaatatttttatcttaacaatattaattctttcaattcataaacatgggatatattttcattagtacttgattatttttggtgctattatagttgatattgttttaaaatctcaaattccaattgtttattgctggtataggaacacaactgaatgttgtatattgatcttgtaacttgcaacttgctaaaatcacgtattacttcaggacattttctttatagattctttgggactgtctacatagaaagccatgccatctgtgaataaggaaagttttacttatttctttgcaatcttatgtgctttttattcttgtcttattgcactagctagaacttccagtacactattaaataggaagtggtaagagaccatgtccttgctttgtttccaatcatagggggaaacattcagtctctcaccattaaatatgttaactctgggttttatttttagatatcctttattaggttaaggaaaattccttctattcctagtttgctaagagatttaatcatgaaaggttgtcaaatgctttttcttcatctactaatatgataatatggtttttcttatccagtctgtgaattacattgattgattttttttttttttttgagatggagtttcactcttattgcccagactggagcgcaatggcacgatctcagctcaccgcaacctctgcctcccaggttcaagcgattctcctgcctcagcctcccgagtagctgggattacaggtatgtgccaccacgcccggctaatttttgtatttttagtagagatggggt[147 bp omitted]tggaatgaatctaactatttttgatgtattatcttttttgatatattgctggattcaatgtactaatattttgctaaggacttttgtatctatattcatgaaagataatggtgtgtagttttccttttttgtaatgcctttatttggttttggtattcatgtaaaaattatctaataaagtgagttgggaagtgtttcctccttttctctgaagacattgtgtagatttagtattatttctttcttaatatttgatagaattcaccaataaagctatctgggcttacagtttttttttctttgaaggtttctagctacaaatttaatttatttaatagatattgagctattcaagttatctgtgtcttcttcagtgagttttggtagattttgtcttttaaagaattggtctatttcatctaagttattaaatttatagacctaccattgtctgtggtagtctctattatccttttgatgtctattatgttagtagtgatgtacccttttatttctgatattggtagttagtgtcttctgtttttcttggttagcttggttaaaagtctatcaattttatattttcagtcacctttttgttgtattgatttctttttatatttcctgttttaattttgttgatttcagctctaattttttattatttctttccttttgcataaggtttactttgctcttttttcttgttttctaatgtataaatgtctgttactagttaaggtaattcccattttctaatatatgcatttaatattataaattcccctttactctctgctttctcttcattccgcaaattttgataagttgtattttcatgttcgtttaattcaacatattttaaatttctcttgaaatttcaaatttattttgaagtatattgtttaatttccaaatatttgggagatttttccagatatatttctgttattgatttttattttagctctgctgtgatctgagaatattctttgtatggtttttattttttaatttgttaaggcttgttttatggcccacaatatggtcaatcttagtgcatattccataggaacttgagaagatgtgtaatttgttgttatttggtggagtattctatatgtgtcaattcagccaagttggttgatagtgctgtttgggttagttataggcttacttattttctgcttatgtgccctgtcaattactgagagaggaatgttgaactctctaactttaactgtgtatttatctatttctcctttcatttccatcagcttttctcccatgtattttgcatctctgttgttagttgcatgcacatttaagattgttatgtcttcttgaagacttgatccctttatcattatgcaatgttcctctttatccccgataatcttccttgttctgaagtttactttgaaattaatatagcccctccaactttctcttgttcagtgtttgcataatatatctttctccatatctttacttttaaatgatctaaaccttcatgtttaaagtgtttttcttaaagacagtatacagttggatcttgcttctttatctaatctgaaaatatctgcctcttaaatggtatgtttaacctcttcacatttaatgtaatattggtatagttagattaaaatctaccatcacactagttattttttctttgttgcatttgttctttgtttcttttttcctctttttctgccttctctattttttattgactattatctatgattgcattgacttactacttatacttattttaaacactttttttttgagatggaatttcactcttgttgcctaggctggagtgcaatggtgtgatcttggctcactgcaacctttgcctcccaggttcaagcgattctcctgcctcagcctcccaagtagctgggattacacgtgcccgccaccacgcctggctaatttttttgtatttttaatggagacggggtttcaccatgttggccaggctggtcttgaactcctgacctcaggtgatccatctggcttggcctctcaaagtgctgggattacaggcatgagccactaagcttggctttaaagacttttaaagtggttgtcctagggtttaaaatatatgttttataaaattaaaatggaggctacagtataaatattccccaagaccaaccacccataatcacttaaccaaaatgtaagtcatctttatttccccacaacacggactctaatcatcaacaaaatacaaaatgtaagcttttggacatccttgttagtgtgattcaaagaaatgaaaccaatcagctatacacaagtcagcttacaccgttctacttgccctaaaaagaatgctaatgtataacagccaatgatgaaatagatcaaaatacttgctcctttctgctgtatctgtgctgtgactgcagtaaggcagtatcttaccacttggctggaagtcttccaccgtgatctgtacttactttcattgtatcacagtaaaccttgaaatgtttcctaatatatatgttttaatataatctgggtccatattcaaataatactgtaatgcttcacatgtagtataaggaccttatgacagtacatttcacatttacagatgctataaatgttcaatacactgttactttactgcttaatggccaatcatattttagatcaattacaaatatggaaaataatatcgcattttaccttcatttatttcatttcttgttaaaatttttcaacttttattttagatacaggggtacatgtgcagattcgttacatgggaatattgcatgatgctgaggtttggagtatgaatcccatcacccaggtagtgagcatagtacccaaaagttacctttttaaccgtctcccctccaccctctagtggttcacagtgtctattgttcccatatttatgtccatgtgtgctctgacactttatttatttatgtagatccaagtttctgacctatagcatattgcttcccacttaaaaatttcctttgacaaggtggccaactagaaggagctagtgtgcagggctcccactgagaggaacggaagggatgagtaaatacagcaccttcaactgaaacatccaggtacatgcattgggactaatcaaggaaacaacttgacccacggagaacggagaaaagcaagcccacccaggagcgacacagagccagggcaacctcccctgcccaggtaagccatgagtgaatgtgcaaccttctggtcaggagatccccttgtgaacccactccaccagggccttcactctgacacacagagctatttggattctcagcagagcagccactcaggcacatgcagagacctggaagccatagatacttgggctttctgggcttcctggcaaaagcaggaggttagacccccataaatacccctaggaaagaggctgaatccagggggttgagcagtgacagttcacaggccccacctcagggcacctcatagaataagacccactggcttagaattccagccagccaccagtagcagtaggggacagagctcctagggggaggggcaggctaccatctttgcttttcaggtaccttagccattccagccttccaactttggaggctccaagctgactggggtggaagagatcccccagaacagtacagctgctctatgaaaatgtggccagactgcttttttaagctggtccacaatcccatttttcctcattgggcaggatctcccaaccggggcctccagtcaccctgcccccctcccagtcccccccacccccacctgcccggtgttctccagtggacagaaatttgaaaactccctgggatggagctcccagagggagggattggccaccatctttgctgtttgggtgacttagctgttccagccttcgggttttggggtgtctgaggcaaccaggtgctgaagtggacccctagcacagcacagctgctctacaaaaacatggccagcttgtttttttaagtgggtcccaaatcctgttcctcctcactgagtgggatctgccaatcagggtctccagccacctcctacaggtgcattcgggctggcagcaggttggtacctccctgagacagacctcccagacagaggggcaggccaccatctttgctgttttgcagccttcactgatgatacttccagatactggaaaatctgaggcgacaaggcactggagcgggcccccggaaaactgcagcagccctgtgaaaaagtggccagattgttatgagggtgcccgttcccgtatctcctcaccaggcagatcctctaggcctgggcttccagccacttcctgccagagctatcgagccagtagcagctgtgcaactccctggacagagcctccaggcgcaactgaaagcttctctgccactgcctctgcagtggaactgcccttgctaaccttggactaatgaaggagcggagaccctcaacattggaccaaatggatctgatagacctctacagaactctccaccccagaacaacagcatacacattcttctcatcaccacgtggcacatactctataactgaccacataattggacataaaacaattctcaacaaatgcaaaagaaccaaaataataccaaacacactctcagaccacagtgaaataaaaatagaatcaaaactaagaaaatcactcaaaaccatgcaactaaatggaaattaaacaacatgctcctgagtgacttttgggtaaataatgaaattaaggcagaaatcaggaagttctttgaaactaattagaacaaagatacaacataccagaatctctgggacacagctaaggcaatgttaagagggaaattcatagcactaaatgcccacatcaaaaagttagaaagatcttaaattaacaatctatcattacaactgaaagaattagagaagcaataacaaatcaatccccaaactagcagaatacaagaaataactggctagccatatgcggaagattgaaactggaccccttccttacatcatataaaaaaattaactcaagatggattaaagacttaaatgtaaaccctaaactataaaaaccccagaagaaaacctaggcaataccattcaggacataggcatgggcaaagatttcgtgataaagacaccagaaacaattgcaacaaaagcaaaaattgacaaatgggatcaaatttaactaaagagcttctgcacagcaaaataaactatcaacagagtaaacagacaacctacagaatgggagaaaatttaaagaaatgtaaagaaatgtaaagaaatttaaagaaatgtaaagaaatttacagtagaaaaacaaacaaccccattaaaaagtaggcaaaggacatgaacagacacttttcaaaagaagacatacatgaagccaacaagcatatggaaaaagctcagtatctctgatcattagagaaacgcaaatcaaaaccacgacgagataccatctcacatcagtcagaatgactattattgaaaagtcaaaaataacagatgctggtgaagttgcagagaaaagggaatgcttgcttatacactgttggtgggagtgtaaattagttcaaccgttgtggaaaacagcatggtgattcctcaaagagcaaaaagaggaactcccattcgacccagcaatcccattactgggtacatacccaaaggaatataaataattctaccataaagatacatgcacgtgaatgttcattgcagcactattcacaatagcaaagacatggaatcaacctaaattcccatcaatggtagactggataaagaaaaggtggtacatatacaccatggaaaaccatgcagccataaacaagaatgagatcatgtcttttgcaggaacgtggagggagctgcagaccattatccttagcaaactaacacaggaacagaaaaccaaataccgcatgtcctcatttataagtgggagctaaatgttgagaacgtatgaacacaaagaagaaaacaatacacactggggtctacttgagggtgtagggtgagaggggggagaggagcagaaaagataactgttgggtactgggcttaatacctgggtgatgaaataatctgaacaacaaacccctgttacatgagtttacctatgtaacaaaccttcacatgtagctgtgaacccaaaataaaacttaaaaaaaattcctctgatatttatcataggttaatcctgctggcaatgaattgtgtcagtttatgttttcctgaaaaaaatctttatttctccttccattggatatttccactggaaaattctaaattaacatttttcttcaaacaatttaaaggtgtcaccttattggtttttagctgtgtggtcctcacaagaagcctgctgtaattcttatctttgttttcccatagtaaggtgttttttccttctcattgccttcaaggttttctcattgtctggttttcagcagttcaaatattatatatctaggtgtgggtttgtttgtttgtcctgcttggtgttctctgagcttcttgggtctgtggtttggcgtctgctactacttttgaaaatattatggccattatgttcttccaaattttcttcagctccattctgtctttcttttcctctggaattaaaattacacatatattgcatcatttgatgttgacttatagctcttggactctctgttctgttttcttcatacacttttctctttgtgtttcaatttggataatttctattgtcctatcttcaagttcactgatttctttccttgactgtgtcaagtctactgatgaactcattgaaggcattctttatttctgttatgctctttttatttattgtatttcactggattctttcttatggggcttctggaggaaaagcctgcaaaagggtagaaaccccaccacgtttgtagcacctcccccaggaacttcacaaccttacactagcccacacttggcccttagcaattcattgaaagttctagttaaatttcctactagtttatacggcattcagttggcatctgccccaagtaagcaaatgtttgtgttctgttttcccctgaaggtgcctgtctctctcaagattttataatacaatagttgcttgtcccatgacttcagtcttctgatggtttctaatgggttattaatttccaacttatccagttttttcttgttgtaagaatggcagtaatgtcttttcagctttatatgactccaagctgaaactggaagtcctataaaatttttttgaaatttattactgccccacaaatcccttttatccccccatgcctcaagtcatctcaatactccttaggtgctaaacctttgaaaccttggatatcttccatgcagtagcactaactcctacactgaaagccgctgttactttgggagctcacccctagcaccacaccttctgaagctgtggttttgcacatacttaggaacattgacaccacacttggccaacagtcagtatggtacagatagtctgtgtttggtctccataagtggtgtttgtgggcagggaacatggtagagtttatgggagctcccccatgggggctgccttcttggaaaagtatccattacatacagagaaggaagctgccttgcttgttttaacaaagggttcagggattagaggtgttggccttctctaggcaggattcctggagtaggagtgtttagatttgagctatagggatctgtggtatttatagaagcttaagtgtcccctcagtttatggcatggggcaaggcagataaatgatctcctaagagatacaactgtgggacagaggtaaaaattcgggatagagccatcctcttctgaatgatatcactggagagaatggggaagtcagagaggtactgtaaactactgggaaataccactggagaagatgggggagatgtcagggtgatatatatccctctgggtaaataatccttgtggttatgagtgagttcagggtaatacagtccccatgtgggtgttaccactgggggagagaggggagaagtcaagatggtaaagttccacccctgagtgctaccacagggagatggaaggagaaatcaaggtgaaggagaagcaaacgacctctgagaatcttagggacatgtccactattcatcaagcattgactgattgcatgcattgttctaaatgctttacatctattaactaatttatttctctgaggtatctgtactttaaggcacagctaatctgggctagaaaggaatatgcccaagtttttttctaatacttgtatattatttcatttttacatttaaatctctgatccatatggagtttgttctcgtgtatggtgtgagatgtgtatccaatttaatctgtttctaaatggccatgtctagtgggttgctgtctccctaaaagatgtgtccccagaacctgggaaaaggatctttgcaaatataatgaacttaaggatcttgagatgagatcatcctggcttaagccagtgggccctaaatccaataacaagtgttcttataacagacagaagaggaaaaagaaacagagagggtgatgtaaagacagaggcagagattggagtgctgcgtctacaaatcaaggaatggcaaagatcactggagctaccagaagctaggagaggcatgtaataggagagaggcatagaatagattctcccccagagcctctaaaaggaatcagctctgatgacatcttgattttttgcttctagcctccagagctgtgagaaaataaatttctgttgttttaagccacccagtttgtggtaatttgttactgcaatcctaggaaacaacatcatttatgtaaaagttcatctttgcctcttatgatttgagatgccatttcaatcatatacaaaaatttattctgtatttggatctatttctggaccttttactctatttcactggcttgtgtactcatgtgacattaccacatagttttaattatagaggctttatagtatgttttaatacctggtggggttaatcaccatcattacattttttggggggtggcttatagttattccttcatgtttattttcccttataaatcttaggcaatttggtttctgagttgatgcatttaactactatgctatgctaactttctaggatatttattagaaaaaagtcagggaaaggggtgagtgaccattcattgagttctgggagattgaatgattggtcccaatttttccctcctccctgtgtccataccctttcccccttggctttgtgcttgcccatgtgatttgctttgcttaatggcatatgggtagaagtaatatgtcatttctgaggctaggccttacaaggctttgcctgtactggcttgccttcttgcccctttgcaccactataagaggatacataggtaattgctgcctcccagtctcagctccagaatggaagacatgtagagcatagttgcctcagctgcagtgccaacagtggggcgcaacttagattagacaaacctcagtcagttctctaaatactggagaataaatttggcacttacccaacagataaataattgcagggaatggaaaaattctaccatgttggagttttctgtcactatttaaaaagtattattgagtgaaaaaatcaagttgcagagaattgagcataatataatctcacttttgtaaaacatccaaaaagaatgtatgtatgtaatataggagaagtgtatgtgtgtgcacgtgtgtgtattacaaacatgaaaataagagtgaaatggttcatacatgacggtttgcactggtgatctgtagggaggattgcaggtattagtgaaggtagaataaaaggatgaggaagttgagcaaataaaaagaagattaaaagtactacatattaaaatctaataagaatgatactattgtggaatgctattcagccataaaagaatgaaatcctgtcatttgtagcaaca[143 bp omitted]tgaaatgctgtctctactaaaaatacaaaaattagctgggcgtggtggcatgggcctatagtcccagctacttgggaggttgaggcaagagaattgcttgaacctgaaaggcagaggttgcagtgagccaacattgtgccactgcactccagcctgagtgacagagtgatactccatctcaaaaaaaaaaaaagaaagaaataagccaggcacagaaagacaaatatcccatgttctcactcacgtggtagctaaaaaagtcgatctcctagaggtaaagagtagaattatagatatcagaggctgggaagggtaagggggataaatagaggttggttaatggatacaaacatacagttagataggagtaagttctagtgttcaatagcgcaataaagtgactacagttaatcatttactttatatttcaaaatatcaagaagaaaagacttgcaagattccaaacacaaagagaagataaatgtttgaggtgatggatataccaattaccctgatttgatcattatgtgttgtatgcgtgtatcaaagtatcacatgtactccataaatatatccaattattatgtactagtaataagaaagaataatagcattgtgtttaggcattcacatgaatgtctacagaaagaagagaaaaagtattgtgaaataaaagctagtatgataggattatatttacacatttacataaaaacagaacctatatatataaaggaatcaaaatcatggttttattgtggaatctcttgctagaaatacacactagggaacatatttgacaggtacaattatatcatattacaaaaatatttaaaacacatactataccttctgttgtgcagtgtattatgaaacatattctcttgaattcagggtatgtccatatcagacatactagttggttgtcctacaacttcgtttgttgacactataaaatacttaaaatttcacagaaaacaggaaaagcatttacataattttccatattccttttttataaggagtttggaatcaatttatgttatagcgctttttgtgggaagtcttttcctaaaggattaaacttgaacaatttctcctcagttgggttctatgaattctatgataccatctccggtcaggttcccttctatacacagaggctaagaaaggcatctggaagcatatgatttatatgttcttcatggtggaacctgtaagggaataagagaaggatagggaaagaggagtcatcacaaggacgtggtttcatgtagagtcaagccttggccccatgcagggcagaggagtgtggagagggggaggagcctctggattgtaaatttcactgcaaagttgttctgccttgagggaggaacttgggctcttgtatccttttataaatcactcactggctactccctaggagggtagtataaccatctccaggcatgttggcactacggaaaaccaaaggcaatgctctggaaaaagttacaggtataagctgtttgctacagcacttgcagcagttagaaaatggatgccctggccagtcaaggggatcagggtgaggcaccaacagtgtatactccacatagtgaggacgtgcaaatatggaaagatgctgctctgatgcattcttagggcttctcctcttaacttggctcatgaatatattcacatggtttttctgctgcaggcattctacagcatacacttagatccaacttctctgagaaggctttctcatattcaagaaacatgcagattttcttttaggtaggaatacttggatgcatattgaaagctaatctctgggtgcagcctttcccacagtcactgcatttataaggtttagctggagaaagagtaatctggtgcttattcaaacttgacttgttggtgaaggccttgtcacactcggtatatacatagggcttttctcctgtgtgaatttgctgctgctgctgaagctagtggtgtgtgtgtgtgtgtgtgtgtgtgtgtgtgtgtgtgaaggctttcccacagtcactctactcataaggcttctctccagtgtaaattctctttgatatgtaatcaaaactgacttgcatgtgaaggccttctcacactcaggacatacatatatgggatgtattagtccattctcgcgctgctataaagaaacacatgagactgggtaatttataaagaaaagaggtttaattggctcacagttctgcagtctgtagaggaagcataattctggcatcaactcagcttctaaagaggcctcaggaaactttcaatcatgatggaaggtgaaggggaagcaggcatgtcttacatggccggagcaggaggaagaaagaacaagtggggaggagctacacacttttaaataaccagatctcatgagaactcgctcactagacagtacccagcagggatggtgctaaactattcatgagaactctgcccccaatgatccaatcacctcctaccaggcccctcctctaacagtggggattacaattcaacatgatatgtgggtggggacacagatccaaaccagatcatgggattttgctccaatatgagttttctgacgtgcaaggagatgtggttttttgaaggccttcccacatttagtgcatgcatagggtctctctcctgcatgactttgttgattctcatggagctgtgacttgaaagaattcccacaatcactgcattcattgagtttttccctaacatgaactttttaatgtgtgattaagtttgacttatggttgaaggctttttcatgttcaggtacatacactgggtttctctccagtgtgaaaattcagatgtatgttgaggtgagacttctgagtaaaggttttcccacagttgccgcattcataaagtttctcatctttgatgtgtaatcaagaccaatttgtaagtaaaggcctttccacattcagtacagacataagctctctacagtatgagtcttctggtgtgcaaggagattggatcttttggagaagaccttcacacattttgtgcctgtatagggtttttctcctgtgtgggttttcccatgctcattcacttgggatttggaatgaaaggctttcccacagtaacagcattcaaaaggcttctctccactatatattctctgatgtgcaatcaagtgtgtcttttggatgaaggcctgcccacattcagtgcatatatagggtttctcttcggtgtgaattctctgttgcaaactgaatattgactactgggtgaaagcgttctcattttctctgcattcgttgggcttttccccagaatgaaaagtctgatgtgtgaagatgtgtgacttctgagggaagactttttcacattcattgcctacataggctatcctcccagtgagaaattttggatgaagaatggacacattcttcatccaaatttgtcactgaggacttttctacattgattaggttcacaaaatttctcacctgtatgagaattaacatagtataagaagctgtaagtaaaatttgactataattaataatctcaaggtttttcttgcattgcttctattgggacttataagttttaattatgtttcaaatcctttccaaatgaatcatatttaagggatggcttctgtgaactaattagatatgggctcatgtgaattgtttttccaatgtacttatattcataatctttttcattattcaatatgttactgttgatgaaagcaaatgactcaaaggtctattttggttttccttacatctctatctgttcatcatcttgccacagttttcattaaaaatggaaacaatgaattgtccctcttgaattcacctactctcttattgtgaaataaagcttttaacagaaatttactattaaagaatttcaatcccacacttccctcctaaaaggagaaaaagaaggtgaaattgaaacatagaacagttagcttagtatagagaagccgtatgcaacttatccagactgaacacagagaaatcacatgatgatgatgataatgatgattcttattatatgctgtacacttaaacagcacttacaacatgccaggtacttttctaagtaatataaaagtattaatacataatacatatatttaaactcatttaactttcatagcaaccctctgaggtagatattattatacatgctttcagaagaaacagctgaagctcagaatgggtaaatactttgcccaagatgacatgggtcctgtgtcaagtagactggatttaaaccaagccagcctgtctccatttacataggctatctagtacccagttagttcttatagcagctcagttttaccctaagtaataaataaatcaacttaccaagaagaggaaatcactaatatttcaattatttttacagaagatgaactatagcaggttttcaatatttataaaatgcataaattgcaccagcagtccccaacctttttggcaccagggactagttttgtggaagacaatttttccatggaccagggaggggggatggtttcgggatgattccagtgcattagattcactgtgcactttatttctattctattattattacactgtcatatataatgaaataattataaaattcaccataatgcagtgggagccctgagcttgttttcctgaaactagatggttccatctgggggtgatgggagacagtgacagatcatcaggcattagattctcataaggagtgcacaacctagatccctcgcattctcagttcacaatagagtttgcactcctatgagaatctaatacccccactgatctgacaggacggggagctcaggtggtaatgtgagtgatagggagcagctgtaaatacaaatgaagcttcgctttccggccccactgctcacctcctgttgtgccgcctggttcctcacaggccacggactatcttccactggtacaagtctgtgatctggaggttggagacccctgaattacaccattattctattctaccaagtttgaagatactgagcatgatctgatcataaaatcccatttgttttcctcttgtagcccaggctaaaatactggcatccagcaccttgtccccaaaactccactatactttcactcttatgctatactcttatatccataaatctcctttcatttattcttaagcatgtcaattcataggcacagatgaggaacttttttgaactttgtacttcatttagcatacacacacaaacacacatacatgcacacacacacacatatacacacacacacaaaaacacatgcacacaaacacaaaccttttactggagccaaaaatatttagttacagctcctactcttcaatgtaaaaagttcatgcctgtgctgaaaatgttatctttaacactcttgagcccaccaacttcataggccacacatacagtcattggtctgaaaaaatagatagtatatgtgagtttgcattccattagtaagtaatatttactcaaaactccagtgtattcctaaatccaatcattattcacatattcttccctcattaagcttgctttttctgccttgtgacgattcaaaatgtatatgtgattcacagatcagttaagagtcctatgctctgaaaattaatctcatgatctaactacatttctagggagacatgattttctctgaattttaagagcagacactatctatgttacccacttttatgctttttaaataatagttgtccacattgctggaatgattaatgaataaagcctgaattctttttgttttcaagccatgttttcccttcccactaacaatctgtttctttgaacacttttcaacacactgaaaacaatcccactgaaacaaaacaccctggtttacctatctccacaaaaccaaaaattttagtacttgaactggtttatccctttttccactaaaaaattaagaataaaatattgctatcacttttattcttaaggattttagaaaagctctaggagggaaatcatcatctgtcatacagtttgaaaatatataatttgcatataaatatttctggaaggaaaccattaatattggtagtccctggggagggatatgggaggaaagagatgggagtgagatttttcactgtgtactctttcatatttttgaatttcaaaccttgtaaatatattatctctcccaaaaatttaaattaaaaactaaaataaaggggaaaagttattagttttgaaattctgagggatggaaggtgaagaaagggaaagatattcaatgctagagtaattaaacactaaatttaatagaactactgaaacctgtatctggagagaaacagccttaaataatcaacagccaagatgcagagaggaatttcatatgtaggaaacattaaggaaaatgagaaaaatggaatagaacatgagttatagaatatatataatgttcaactagaaatttgtggactgttgtcactgagaagagtttaatgatcatttgctacataatagggagtaacttccatttcatttcataaagtgagcataaaatagatgtcatgttttagataataaaatctgtcagtagtacttaaaataaacatattaaaaaaaaaaaaaacaaggggctggggagccaagatggctgaataggaacagctccggtctacagctcccagcgtgagcgacacagaagacaggtgatttctgcatttccgtctgaggtaccgggttcatctcactagggagtgccagacagtgggcacaggacagtgggtgcagcacaccatgcatgagccgaagcagggcgaggcattgcctcactcgggaagcgcaaggggtcagggagttccctttcctagtcaaagaaagaggtgacagatggcacctggaaaatcgggtcactcccaccctaatactgtgcttttccgacgggcttaaaaaatggcacaccaggagattatatcccgcacatggctcggagggtcctaggcccacagagtctcgctgattgctagcacagcagtctgagatcaaactgcaaggcggcagcgaggctgggggagggatgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttcttccagcatgcagctagagatctgagaacgggcagactgcctcctcaagtgggtccctgatccctgatccctgacccccgagcagcctaactgggaggcaccccccagtaggggcagactgacacctcacacggcccagtactcctctgagtcaaaacttccagaggaacgatcagacagcagcattcacggttcatgaaaatctgctgttctgcagacaccactgctggtacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagtgcctctcctcctccaaaggaacgcagttcctcaccagcaacggaacaaagctggacggagaatgactttgacgagttgagagaagaaggcttcagataatcaaactactccgagctacaggaggaaattcaaaccaaaggcaaagaagttgaaaactttgaaaaaaatctagacgaatgtataactagaataaccaatacagagaagtgcttaaaggagctgatggagctgaaaaccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaataaaaagaaatgaacaaagcctccaagaaatatgggactatgtgaaaaggccaaatctatgtctgattggtgtacctgaaagtgacagggagaatggaaccaagttggaaaacactctgcgggatattatccaggagaacttccccaatctagcaaggcaggtcaatgttcagattcaggaaatacagagaacaccacaaagatactcctcgagaagagcaactccaagacacataattgtcagattcaccaaagttgaaatgaaggaaaaaatgttaagggcagccagagagaaaggtcgagttacccacaaagggaagcccatcagacaaacagcagatctctcagcagaaactctacaagccagaagacagtgggggccaatattcaacattctttttttttattattatactttaagttttagggtacatgtgcacattgtgcaggttagttacatatgtatacatgtgccatgctggtgcgctgcacccactaactcatcatctagccttaggtatatctcccaatgctatccctccccactccccccaccccaccacagtccccagagtgtgatattccccttcatgtgtccatgtgatctcattgttcaattcccacctatgagtgagaatatgcggtgtttggttttttgttcttgcgatagtttactgagaatgatgatttccaacttcatccatgtccctacaaaggacatgaactcatcattttttatcgctgcatagtattccatggtgtttatgtgccacattttcttaatccaatctatcattgttggacatttgggttggttccaagtctttgctattgtgaataatgctgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatatccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaatgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggatctgttctgttccattgatctatatctctgttttggtaccagtaccatgctgttttggttactgtagctttgcagtatagtttgaagtcaggtagtgtgatgcctccagcacacttcttttggcttaggattgacttggcgatgcgggctcttttttgcttccatatgaactttaaagtagttttttccaattctgtgaataaagtcattggtagcttgatggagatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagtaggattcctaggtattttattctctttgaagcaattgtgaatgggagttcactcatgatttggctctctgtttgtctgttgttggtgtataagaatgcttgtgatttttgtacattgattttgtatcctgagactttgctgaaggtgcttattagcttaaggagattttgggctgagacaatggggttttctagataaacaatcatgtcgtctgcaaacagggacaatgtgacttcctctcctaattgaataccctttatttccttctcctgcctgattgccctggccagaacttccaacactatgttgaataggagcagtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagctttccatcccagggatgaagcccacttgatcatggtggataagctttttgatgtgctgctggattcggtttgccagtattttattgaggatttttgcatcaatgttcgtcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgttaatccatctggtcctggattctttttggttggtaaactattgataattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcagtggtgatatcccctttatcattttttattgtgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatccttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgatcttttacatttgctgaggagtgctttacttccaactatgtggtcaattttggaataggtgtggtgtggtgctgaaaaacatgtatattctgttgatttggggtggagagttctgtagatgtctattaggtccgcttggtgcagagctgagttcaattcctgggtatccttgtggactttctgtcttgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtgtgttttatcagagactaggattgcaacccctgcctttttttgttttccatttgcttggtagatcttcctccatccttttattttgagcctatgtgtgtctctgcatgtgagatgggtttcctgaatacagcacactggtgggtcttgactctttatccaacttgccagtctgtgtcttttaattggagaatttagtccatttacatttaaagttaatattgttatgtgtgaatttgatcctgtcattatgatgttacctggtgattttgctcgttagttgatgcagtatcttcctagtctcgatggtctttacaatttggcatgattttgccgcggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgcttttagtctgatgggcttccctttgagggtaacccgacctttctctctggctgcccttaacattttttccttcatttcaactttggtgaatgtgacaattatgtgtcttggagttgctcttctcgaggagtatctttgtggtgttctctgtatttcctgaatctgaacattggcctgccttgctagattggggaagttctcctggataatatcctgcagagtgttttccaacttggttccattctccgcatcactttcaggtacaccaatcagatgtagatttggtcttttcacatagtcccatatttcttggaggctttgctcatttctttttattcttttttctctaaacttcccttcttgcttcatttcattcatttcgtcttccattgctgataccctttcttccagttgatcgcattggctcctgaggcttctgcattcttcacgtagttctcgagccttggttttcagctccatcagctcctttaagcacttctctgtattggttattctagttatacattcttctaaatttttttcaaagttttcaacttctttgcgtttggtttgaatgtcctcccgtagctcagagtaatttgatcgtctgaagccttcttctctcagctcatcaaagtcattctccatccagctttgttccgttgctggtgaggaactgcgttcctttggaggaggagaggcaccctgcgttttagagtttccagtttttctgttctgttttttccccatctttgtggttttatctacttttggtctttgatgatggtgatgtacagatgggttttcggtgtggatgtcctttctgtttgttagttttccttctaacagacagcaccctcagctgcaggtctgttggaataccctgccatgtgaggtgtcagtgtgcccctgctggggggtgcctcccagttaggctgctcgggggtcagggatcagggacccacttgaggaggcagtctgcccgttctcagatctccagctgcatgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccagctgctttgtttacctaagcaagcctgggcaatggcgggcgcccctcccccagcctcgctgccgccttgcagtttgatctcagactgctgtgctagcaatcagcgagattccatgggcgtaggaccctccaagccaggtgtgggatatagtctcgtggtgcgccgttttttaagccggtctgaaaagtgcaatattcgggtgggagtgacccgattttccaggtgcgtccgtcacccctttctttgactcagaaagggaactccctgaccccttgcgcttcccaggtgaggcaatgcctcaccctgctttggctcgcgcacggtgcgcgcacccactggcctgcgcccactgtctggcactccctagtgagatgaacccggtacctcagatggaaatgcagaaatcacccgtcttctgcgtcgctcacgctgggagctgtagaccagagcttttcctattcggccatcttggctcctcccaacattcttaaagaaaagaattttcaacccagaatttcatatccagccaaactaagcttcataagtgaaggagaaataaaataccttacagacaagcaaatgctgagagattttgtcaccaccaggcctgccctaaaagagctcctgaaggaagcactaaacatggaaaggaacaactggtaccagctgctgcaaaaccatgccaaattgtaaagaccattgaggctaggaagaaactgcatcaactaacgagcaaaataaccaggtaacatcataatgacaggatcaaattcacacataagaatattaacttaaaatgtaaatggactaaatgctccaattaaaagacacagactggcaaattggataaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacacactttaaaccaacaaagatcaaaagagacaaagaaggccattacataatggtaaagggatcaattcaacaagaagagctaactatcctaaatatatatgcacccaatacaggagcactcagattcataaagcaagtcctgagtgacctacaaagagacctagactcccacacaataataatgggagactttaacaccccactgtcaacattagacagatcaacaagacagaaagtccacaaggatacccaggaattgaactcagctctgcaccaagcggacctaatagacatctacagaactctccaccccaaatcaacagaatatacatgtttttcagcaccacaccacacctattccaaaattgaccacatagttggaagtaaagcactcctcagcaaatgtaaaagatcagaaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaataaggatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaagaaaagagagatgaatcaaatagacgcaataaaaaatgataaaggggatatcaccaccgatcccacagaaatacaaactaccatcagagaatactacaaacacctctacgcaaataaactagaaaatctagaagaaatggataaattccttgacacatacaccctcccaagactaaaccaggaagaagttgaatctctgaatagaccaataacaggctctgaaattgtgtcaataatcaatagcttaccaaccaaaaagagtccaggaccagatggattcacagccgaattctaccagaggtataaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgacgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatttcaaaataataagagctatctatgacaaacccacagccaatatcatattgaatgggcaaaaactggaagcattccctttgaaaactggcacaagacagggatgccctctctcaccgctcctattcaacatagtgttggaagttctggccagggcaattacgcgggagaaggaaataaagggtattcaattaggaaaagaggaagtcaaattgtccctgtttgcagatgacatgattgtatatctacaaaaccccattgtctcagcccaaaatctccttaagctgataagcaccttcagcaaagtctcaggatacaaaatcaatgtacaaaaatcacaagcattcttatacaccaataacagacaaacagagagccaaatcatgagtgaagttgttctttatagaagtattccagctgataaacaaagagggagggatagcattaaaatatcactattttgaaaatcctaatgaaataatggacctaggcaatgatcatcaatggatgctaaacatttaagtgaaaggctgcagggagctttataatctatggatcaggttcaacaacacctgaacccactgattaatcttagcacataaagaaagatattgaggaattatgcacctctcagtgagatgcaagaatatgtacgaaacacaacttatgaattattctatcaaaaaattaaacctgaatatgttcaagcctctggagctaacagcttgcattaaatatgaaggatcaaggaatatcttcagtgatatcacaaggatgtcgtcagccaaatccagaatatgggacattctacagaacaaatgacccagtttctttaacaaataaatagcaagggaaaatgtgaagctaatcttttatagagtaacataaatttaagaactatatctcacaaatgcaatgtgtggcccttgtttgaatcccaactcatttttttaaaaaggcattcatcaaatatgcccaactgactttttttttttttttttttttttgagacagggtctcattctgtcgcccaggctggattgcagtgccatgatcacagcccactgcagccttgccttcctgggctcaaatgatcccctcttgcctcagtctcccaaagtggtgggattacaggcataagccactgcacccagcctcaactgatttttgaggaagatgtaaaaacagttcaatggaagaagtacaggcttttcaacaagtggtgttggtgcaattagacattgtaagcaagtaaataacctcaacataaacctcacaccttatacaaaatataattcaaaatggatcatgaacttaaatataaaacataaaacaataaaacttttattggacttcatcaaaattaaaaacttttgctctgtgaaagatcatgtgaagagaatgaaagacaagctatagacagggagaaaatatttggaaaccacatatctgacaaaagactgacatctagaatatataaagaacctcaaaactccatggtaaaaatccagacaatccattagaaaatgggcaaaatatatgaatagacattttgccaaagagcatatagagatgacaaataagcacatgaaaagatgttccacatcagtagacattagggaaatgcaaattaaaaacacagtgagacacctatcagaatggcaaaatgaaaagtggtgacaatgtcaaatgctggtgagggtgtggaaaaactggattattcaagcattgctggtggcagtgtaaactgtaaagtaccacagtcagtctagaaaagactttggcagttcttataaaactaaacatgaaattaccataaacccagcaactgcactcttggctgtttctctcagaaaaataaatgaaacttgcgttcacacaaaaacctgtacacaaatggtcatatcaactttatctgtaatagctccaaactggaatcaaccagttatccttcaacaggtgaatggttaaacaaacatgtacacccatactatggaatactactgagcaatgaaaaggaatgaactattgatacctgcaacagcttttcattcattcattcattcattcattgaattcattcaatgaatgaatgaatctccagggaattatgctaggtgaaaagagccaatcccaaaaggttacatactacagatgctactcgacatacatcctgataaatccatcctaagttgaaaatacgataattcaaaaatgcatttaacacacctaacctactgaacatcatagcttagcctagcctaccttaaatgtgcatagaatacttatattagcacagttggacaacataatctagcaagaagcttatgttataataaagcattgaatatttcatgtaatttattaaatactgaactgaatgtgaaaaaacggaatggttgtatggatacttgaagtacagtttctactgcatgtttatcacttttgcaccatggaaaagttaaataattttaagtcaaaacattgtaagccagagaccatctgcacatgattccatttatataacatttttgaaatgatgaaattttagaaatagagactagattagttgttgccaggggttttaagacaaaggggtaagaagagaagatagttatggttataaaatcgcaacaatgaggatcgttatggtgacagaactgttctgtatcttcactgtggtggaggatataaaaacttatacatgtgataaaattgtacaaaactaaatacacaaataagtacaagtaaaacagggaatctgaaaaagaacagtatatagtatcaacatcaatattcttatttaaatttaaactaaaaggacacttatgagactattaaggaaatgctatggtttgaatgtgtcccccaaagttcatatgttagaaacttaatctccaatgcaaaagtattgagaggtagggcttttaagaggtgattaggtcatgacagctctgccttcatgaatggattaatgttgttattgtgggagtgggttcctgataaaaaggatgagtttggtccccttcctctctcacacacacatgctcttttgccatgcgatgccttctgccatgttatgatgcagcagaagtctctcagcagatgtggccccttgaccttggacctcttcttcttcttttttttttttttttttgagacagagttccccttttggtgcctgggctggagtgcaatggcatgatcttggctcgctgcaacctctgcctcctgggttccagtgattctctcacctcagcctcctgagtagctgggattataggtgcccaccaccatgcccagctaatttctgtatttttagtaga[154 bp omitted]atttattttctttataaattatccagtctgtggttttctgttatagcaacacaaagtggtctaagagaggaaatttatacacagtgtaggaacagataatattaagaaattattttcttaatactgttaatattttcagtgtgataatggcattgtagttaagcagggatacatactaaagaaagtaaggaagaaatgatattacttcagtgattttctttaaaataacccagcagtagtagataaaacaagattggtcgtatgcccataactattgataactgttgtatattgatgatggatacaagggggttcattatactatttttgtgtttctgagtagcttgaatattataaattacacatggataagttctgtaatatgaaaaaaatagacagtttttaagaaaaaaggaggaaatgaacacagaatgagctcccatacggtctaaaattgtactaaaaattatatatgtaactaattccccttataattttgatctatctgtggctcaagcagtgtcaaaagactgctgttatagactgaaagtttgttcccccaaaattcatatgttgaaatcttaacccccaatgtgatggtattagaaggtgggtccttttggaggtaattatgtcataaggtcagagcctttataaatgggattactgcccatataagaaaagacacgagagagatgatctctttctctctctcagccatgtgaggatacaacaagatgaccatctgcaaaccaggaagagggccctcaccagccaaagatttgccagcaccttgatcttgaacttcctagcctccagaactgtgataaataaatgtttgttatttaagccatcagtctatggcattttgttatggcagcctgaactaagacagctgcccaagaaaactattacatgtcactgaaatgcattcagtccctccactgaacatataatttaactttttctctttgtgtgaaatcaggccatcagaaaggtgtgtcctcaaatactcttggttgcttgttataatacatttgctgagatttgctttgaccctaggccttttgctgcctctgaagaatgctctagaacagaggtaggcagccaccctcatttgtttacacacagtctatggctgctctcatgctacaacagccgaactgagtagttgctacagagaccatatgacacacaaagcctaaaatatttattatctggccctgcagacaaagcttgccaagtcctgctctagaagatagcagaagcaaacacaatacagtagtctccccttatccatggtttcattttctgtggtttcagttacccatggccaatcactgtccaaaaatattaaatagaacattccaaaaataaacaattcatgagttttaaattttgcactgttctgagtacgttgatgaaatcttataccatcccactccatcctgactgggacatgaatcatccctgtgtccagtgcatccatgctgtataccctatctgcctgttagtcacttagtagccatgtcagttatcaaatcaactcccgtggaatcacagtgcttgttttcaagtcacccttattttactttataatggccctgaagtgcaaaagtagtgatggtgtcaatttggatatgccaaagagaagccataaagtacttcttgtaagtgaaaaagtgaaagttcttgacttaataaaagaaaaaacttgtatgctgaggttgttaagatctacagtaagaatgaattttccatgaaattgtgaagaaggaaaaggacattcatgcacaggatatgtaggaatcagtactatccatggtttcaagcatttactgggggccttggaacatatccccagaggataaggggggactgccatactactactatacacgtgatggagttgctataaataacagtgttatttataccctgggggatacatgacttgctgtcctggagaattgaaggacatcttgtttctaggcatgactggaacagagccccagtgttccagccagtccctgcctatttcaagatgttgccttcccagaatgttctacagttatcttgagaactgcaagtgagaaaagagggagaaccgggtcagtctaaggccacccagagttattatattgctataaataacaacattatatattagtcaatatatagtcatatattgaacatatagtcagcctaataatagggttctgtgactagttgttatagcataattatgaacagaacccccatgtatcaatttatatgaagatttatcaaaaatcttttgaaaactccatccagagagtctttactatagaggaattgtcacattgtccttgtgacaattaaatgtaaattatataattgcttatatttctttcattctatatctgccacaaagaacacaactttatagtttaattttaataactattgcaggacacttctctgggtggtcttggactgacccggttctccctcttttctcacttgcagttctcaagataactgtagaacattctgggaaggcaacatcttgaaataggcagggactggctggaacagctggggctctgttccagtcatgcctagaaacaagatgtccttcagttctccaggacagcaagtcatgtatcccccagggtacaaaacccagggtgagttgctttctggggtccctcagctgtggggcaagtgaggcatacacagacaagactccttccttctctggcagctttcctgagcctcaggggacccgctcataatgattcctaggcttccattgtcccttgctgcctgtctgtaagtaataaacctgattcatgtaacttgtgtgtgtgtggatgttctgtcccactggactcagagaagttggtaatcagtgcacagtgaacctgtttcgtatctatgttactaaaattcattcaacactgcatgaatatttacagtccactgatgctctgttgttgactgtgtcaacattgtctgtgttttccctgatcatattatagattcacatgtattcatgttactattctgattattataaacctcctaaatccaatggtaaatggaagcaataactaaacaaagaaacaaatgatgacttagcagagaccaggtcttttctggttcttttgtagagaagaaaagggatctatgaagtcagagttggggaagtgaggatgtacaagtgaggggataccttgcagagtctagaatcagcagggagctgcctcccttctcctctaggccatggggctgaaccctccacatcccccctctcctccatcaactacattatacagtccactgaaacacgcaggtctctggataagctgctgaaaggggacatagacattggaagtcagaatggaactgatctatttggatttggaaatactcatgagtacccagacttacagatgatattgtctggagcattatggtgcaacatccataaggtctctgggaaagcctgccttatattcccacacagagggtacaacagcagtaaactccacaacagagggatatgcctatccctgcggtccaggttaatgttataagcaacttttgccattagaattgtcctgacctgaatcaggatgctaagcattagtctagagacaatgtgtggccagacatagctttgatttgttggtgcatgtcttgtggggctatctgaggcatttcctgaattcttaattataaagcagtttccccactgccaatcacaaccagatatgatgataggttggctaagtatatatatttaacaggctacagagagagctatgaatactcatgaaagtagtgataagccctgtccagttcttgagactggatcagcttaaatagctgtgtctcatccaggaggcggcattacagatgggctaggcctctgcctctgatggagacaaacaaatttttaataagaggcatttctatggaaacagaagaaaaacaaagattaatgttgggcacaatttattcagatgttagactccaggatcttaattatagaggaggaaggaagaggcaatctgacacttttttctcacctatgttacaaggaataagctgcagcttgcagggcttcaggaaaaaggtactagcaatttcattgaatccaagtcagaaaagtaaaagaaaaaattggaaaacattagtttggggactcatagcccggaaataatttaggattcactccaaattgtagaaaataataaaaactcaacaacagtgaacaaaactagaatctaacaataagtgtactacatttttttccaaaacatactttttctctctccagtccctgtttttactaaagacaaatcacagtaggacaaatgtatttgcaaaataaattttagtcttactattcttggcctaagtgtttgcataaagtcagcaggaataattatttgtcatataggctcttttgaaaattggctttgctggaactttattccataaggaatcttggattagactttcaaagccttgagcccagccatggattcatctgtgcctgcaatacttgtatgatttgggtgaattcctcacttcaggtcccaagataacttggagctcctaggcctgtcagagaatgacattctttacttaccacaggtcaaaaaccctatacagggactgcatagacaatgcatgaggccagtttttccaaggggcttttatgggctttataagtcaactttgattccttaaagcagtatgaaagtgtgccattccaaccaaagccttggtaaagtaaccagtatctccagttgtgtcttgttagataagaaaacagattcttattgaacttatgcaaataacttaagtatactaacaaatggttttaaaattctggagaaagcaagtagagggaaagaaatgtgtttcaagttttgctcacaggagtgtactttatgcaattgttaaaagctgcaaatagctcaaaagaaaaagtttttctggattctgaaaaacaagagttagcaatgttttaaacaaaatgccataaaaagattttggtcttctgttggttcagtctatgtaattaagtcctgttccactcaatattcatgaacacattagctctctatgggagtcttggaagttttgcctctattctgatgccacaatctctgaagttatcagaaacctgcattcaagagcagctctcagagtcctatagctgattacaaaatcgtttgaaaataatcaaagtaaaacaattgtggatgacaaaagtcttagaataaccatgattaaagtctgaacatctctgtggcatgcagcaatttaatataacaattataattattacttatatactgagacataacagaattgcaagaatcatatacaattttggaacacacaccaataacacatttatacaaatacaacccaaagagatctgaaaaccattttgtacttgacaatacttcctgtatgattttaatatacagaacaagctgaatatgtccctattggactttaggggacccaatatctaaaagtgttaaccagatcaaaaaagggggcttaatttaaaatctgactgtggaaagtttgtcaaatatcaaaggtttaaacacttagtattataaaataaaattctaggtcaccattaataaaagggaaaaatctgtactcattaatagaggggaaacagctttccaaacaggacccaataaagatgcatgaggccagttgaatctgtctcctctcctctcgcttttttctgtcatttattccaaaggtaaacaaaaatatttcactatcttttaatattacatgcaaatcttgttcaaaagagaaagctaaatttcacctttgtttgcattagtgtactattaatgttaaacccaattcttaataaaaccttataaacaaaatctatccaatcttaattagtttgactataaggtaaaatttccagaaaccttttataatcctttacagctttctattaaacagcagatcaattctctaagaaaaccctgttactcagacacaggggcccagattccggccctgcatcagtgtgctttcatttcaatgttcaacccacaaaaaaactaaatcatccctttcaaatcttaggcaacttgcttatacccactgaacttcgtttataagatccacccttcacaaattcttcacaacttgcttaaactttcagttttgtcccattactcctctatgttaggacaatcttaacctctgaacaagacaaaattacattccctttaacaaaaaccatgttttcatgccttcttataatcttttaccaaaaacacattctactttccttacacaccttgcatgtaaaactatttttccagtagtcgcaagtacatattacaatgttaactcttagcaacttttattgttggtgaaaacctggcgagtaagcaattttaaccatgtataagattgcagaacacatgacttcccagcctagccagggggcctggctaacttcatatgtccccaggccttacctaggatctaattgctgtaaaacaggcaagtcaagcaattactaaaagtcgtagaagcagtttatgaccttaaaacatctagcaaacagtatccgatccccccaatttagaccaaatatctaaattttgaagatatttttattttactttaccaataatctttaagctgtctttatttttcaaagattgttagagacattgtgacttaaaaggcattaaagtctatttttctgacaaaatattttatttaagtgcttatcattcttaagccaataaattagaccactatcatatattctggtagcgaaacatcacacacatcatatataaatacacagatatggagatgatttggtagggtgacaaaagattagatgcaagaggaaggaggaacagacaggagcaggtgcagaattagacagatatccatcaactgaggaggttttagaggcagagcaggggctttaaaacaatatccatgcacatatagtgcaaatatcagccttaattaagttgatttcgaactacagagctctccaaaggagaatcattttaaaatattttattactagattttagtcaagagaaatggccaatatttctggcttttgaattcttttacctcctacatgaaatcaataagccttaactaacggtatgactttaccacaggtgcatgaagtatcttcaatgagacagcaagcggtttttacaagatctagaattgctccaaaggtagctcagagaaaagaaaatttcaagacaggaaatcagaagctgtccatggaagggaaaagaaccaataaatggcaaaaagtcacacacatagcgaatgggaaaggactaattacctaagctgggaattgaacccaggctgccagtgtgaaaggccagaatcttagctcctgaactattgcacaaggtgacgactactgcttcttcccaggagtctagagcagtcatttttgagcttgcaaatgattttaactattcaagaaaatttagactagatataacacaatcatgtgtcctttttagtctcaagagtcaaagccctgtaacttaacggcgcaaggactttaaagacaatacagaaacttacatggatacaataacctttttaagtccataatttgaattagcttttaaataacttttgaattagacaaaatttttttttgtcaataagaacatattttccttgtcacattttctataaaactaggaagcaagaaattctttttttgaaaaagtgaaagcaattttattaagaaagtaaaggaatagccggctgtgtggcagcccgcgaggcggtccgcgggagcacactctgtgcagagactgggcggccagcctgcccttgctgtcgctgacggtgactgcgggaggccaggttgtttttcatcattcagaacattgcctgaagcaggtccaccgtgccgttagtaacgaggaacatcgagccaaggcacctgtgccgtcagacgttgcctagcgttagaagcgagctggaatgcgtgaccaacatcaccctggcaaatgtcatccgacagctgggcagcctgagtaaatatgcagaggacatttttggagagctctttactcaggcaaatacctttgcctctccggtaagctcccttgctgagagggtcgatggactacaagttaaagtcactcagctggatcccaaggaagaagaagtgtcactgcaagtaatcaacacccgaaaagccttcagaagctccaccattcaagaccagaagctttttgacagaaactctctcccagtgcctgtcttagaaacatacaatacctgtgatactcctccccctctcaacaatcttaccccttacagggacgatggaacagaggcactcaaattctacacagacccttcatacttctttgatctttggaagaagaagatgctgcaggacaccagggatatcatgaaagagaagagaaagcacaggaaagaaaagaaagataatccaaatcgagggaatgtaaacccacgtaaaatcaagacacgtaaggaagagtgggagaaaattaagatggggcaagaatttgtggagtccaaagaaaagctggggccttttgggtatccacccaccttggtgtaccagaatggcagcattggctgtgttgaaaacgtggatgcaagtagctatccaccaccatcacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaagctctaaacccgggtttgctccaccacctgcccctccaccacccccgcctccaatgataggcatcccacctccaccaccgcctataggatttgggtctccagggacgcctccaccaccctcaagcccatctttcccacctcaccctgattttgctgcccctccacctcttcctccaccaccggcagctgactacccaactctcccaccacctcccttgtcccagccaacaagaggagcacctcctcctccccctcctcctcctccggggccccctcctccccctttcactggtgcagatggccagcctgctgtaccaccaccgctttctgacaccaccaagcccaagtcctccttgcctgccataagcgatgcccatagcgacctgctttcagccatctgtcaaggttttcagctgcgcagggttgaggagcagcaggaacaagagaagtgggatgtcgtgggcaatgacgtggccaccatcttgtctcgtcgcattgctgttgagtacagtgactcagaagatgactcctctgaatttgatggggacgactggtctaattaactctttctgcctgatgcccaccttctttttctttccttcctacttgccttctttgatgccaaccccaacagacccataggggagaaaagggaggaaaaacctaattttaaggggccgaagctttccctgaagcaaccaaagctatatccaagtgcttcctccaagtcacatgtatttcctcttcccattgtcaggccctgtggggctcctgagattcagtagctgggatgttccctctttccttcaagtgcctgttgcatgtttaaaggaaggagaaatcccaaagcagattcctttgattgggtttccgttggagatggggccttcccttaggagccatattcaactacagtcttctaaaacctgtgccctcagccacttcgaataatgccagccaccttctggttctaaagcagagggagtggcctgaatggacacagctggcccctttcccgtacactgaaagggcagagcaggcctaaggctccaacggccaaactgcctcaccctctgccctaatcagcagggtgggcctgccttttgctaagcgatctctatgcctgggattccctttattccaggagacattaagcctctaaagaatgtctcatctcctctgcccaaaaatgatgctcttctgtaggctggtgttgttgcttccctcccaggatccctttggtgagtgtggtgttcaggatgcaccagcaccacctctacatgccttcaggcaacacggcccagttttaacctctagtatccatgaccaaactatccctgacacataaggacaggggcctcttctggctgtcaggagcaaagcctgaagacttggagctgcaggactggaagaacagtggagccccgtgggtcccaccctttaaggatgctgaggcctagagatgggaagtgacttgctcaaggtcacacaattggatagtgacatagctagagcccagagttcctgattccaagtcacctgtgctttctgggaccaaagaatgggcacctgctggagtcttggcagagctttcttggctgtattgctactccagacctcatcataggttggggtcccagtaggagggctcagggtctgtgccagccctgtcagtgctgctcagaccttcatagcctctcttgtcattctttgttgccccttttctgtcaccaaccaaccacatagccttgggaccagcccctctgggggaccagaagtagtgagagaaggaaggggataggcagctttgacaggtgctgttttcaattcctctgcaactcctcccccttttatttccccaatttaaacaaagattctgccaactgtggaaacttcagtccctcaggctggcagctgtgctggtacctgcctgggggggcctggcagtcgtgaagcaggctgaaaggcagaggggctccaggtcctgtttccagctcccctcactgcacatggtgaagctccctccctccccacttttcccagagctaatacacaggtgctattattcagaaaaaaactggtcagctctaaccaacagtgaggtttcttctcttctgccctaactattgtgtagcctcttatgctgaaattggcttctgccggcttatctggctttcagagccctgaaacaaagagaaacaggatctgtccctacccagcacagcaaatggttgtagtaattgccaaagccctcgtaaagccctccggcttgaggagacagtgtatagtcatgagttctgcctctgtgcccttgctggccgcttcccctttgccttctttcctggaactcagggtgtggggactgagcctgtaggggccagcaggccctcctgctgtggccactcccaagtgtgccctcttccctctctccagatcaggtgtctctagcacaggacttggcaccaagctccatgctgagacaccaggctatgtgggcccccaccttgtttcccagcctgtaccttggaagccgaaggtgctttcatcagaatcctaaaatggccgttgaaggcgcctgggccgcagcccagcagtagctggagaggcaggcagagggcagtggttctcccaaataggagacctggggcctggccaggccagggtttgggcctaatggctttgactgaattacccccatcctcctcctttctggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctgtgttctcatcctacagttggtttggtaatgatctgcaagtcccggagagcaacagcaaagctctgcctgatgctctcattaaaatctatgcagccaagctcagcactttgtcacagccggccttgcgaagcctcctcagctcggggggccggggacccagtgagctgggaggccctctgggctccacttatgcatatgcaccaaaaaaaaaaaaaaaaaaaaaaggcttctttagacccagagccctttaagatgataaaggacccaatgcaggtaatcctgtttttggactcatgtaatgtagaatgctaaatttagtgattatttaatctgggcctaagctagtgagagtgtggaacaatggcccataatgactcctaagcggtgaagccagggggcctcctcccttcctggttcaccccgcccaggggacctgctcccattcctatggccctggggcccagcttccaatagtgtcagaagtgacttgtggctttgccttggttgtgagatgggtacattctaaaggagcagcccgggggagggggcaggcttagccagcccttggaggctcagagcagctggcccaggctccagctcgcctccagtggaagcccgagcgctgtcagaaacaaccctggccaatgtcaccgcagagccgaggcggtgttgtcagggctaatgtgaaatctcttcccgtggcgctgatcctccgactctgcagcaccagcttggacagactgaggtctctgtggctttgctgactctgcttaagcattcccaccgggtcccagctctgctctaggactgcctcccactgcggcccctcacctgacctcagggcatggggagggagggagccagttccccaaggccaggggactttgctcctgagagatgtcagacttcctggaggcatcaggctttgagttctgctggggtccagctgacctggcaccaggtgtcgcacagagatgtgcctcattctgtgcctcctgccgtgttcactttaactgtgcctcagtgtgggttagggaataattttgtcattgtattaagtttatccagttaattaacttgaggaactaaccaatttttaccttctgtctagaatgatgtacatgtagtagagtaagccataatgctcccaaagtgccttgttttctctgatacaaacgtatttataaggacgtattccagtgggttcttgggtgtgtttgccacaacaagattttagggaaggggtgtatgtgtagtagggatgccgtttgaaaacaggccctcttcccctgaggaagggaaaggaactcttcagttggagatctgggcagtgggttaagccagacccctaaagtgaccctttcctcttctgccctattcttctcagaccctccgaaagacatccaatttttttaaagccctgtagctccaagcctggtctcatttgcttccctgccaggctcattgtgtgtataccacatttgtgccccactgacctgaaggttccatgtaactgtatacacatgaatacttaaatgccaacattttaaataatttgataaagtctttgtagccacaaaaaaaaaaaaaacgtaaaggaataaagaatggctacttcatgggtaagagcagtggcatgggctgctcgactgagtatatttatagttatttcttgattatatgctgtattaatccgttttcacactgctataaaagaacttccctgagactgggtgatttataaaggaaagaggtttaattgactcagttttgcgtggctggagaggcctcaggaaatgtataattatggcagaaggggaagcaggcaccttcttcacaagatggcatgggagaaaagagcaggggaaaccgtcacttatagaaccatcagatcctgtgagaactcactcactaccacgagaacagcatgggggaaactgcccccatgatcctgtcacctcccaccaggtccctcccttgacaggtgggaattatggggattacaattagagataaaatttgggtggggacacagagccaaaccatatcatatgctaaacaacgggtggattattcatgagttttctgggaaaggggtggggatttcccagaactgaggggtcctcctctttttagaccatatagggtaacttccagacattgccatggcatttgtaaactgtcaaggcaccggtggaagtgttttttagcatgctaatggattataattagcgtataatgagcactgaggattaccagaggtcactttcgctgccatcttggttttggtgggttttgactggcttctttactgtatgctgttttatcagcagggtctttgtgatctgaatcttgtgtggacattttatttcatcctgtgagataagaatgcctaacctcctgggaatgcagcccagtaggtctcagccttattttacccagcccctattcaagatggagttactctggttcgaacacctctgacatattcccccctcccttttacaagggaacccttaatcctagcaattgtagagggacaaagatccatcttctgtaattttcaggccaaacagggcgatgacattcctgcctaactactggggtgtcttgtatccagggtagagaggagctcagtgagaaaacatcattacactgagggccattcataactccgacttctgatcaaaggtgatatctggaagattggtatgtgttcaatttaagaaaacattgagtaagcttacctatccagcatttctacacagaatacagcaggaatatattccacaacagtaaagtaaaataagcaaaattattctaagtaaatgaaaaaaataaggcattcaatgaactgggcagctgttgggaccaaactgatatggggttgctagccaattccaatatgtgcccagaattagaatattgatccagatttctacagtacccatccctcttgtttcttctgagctccagttaaagatcactggttgattcacaggaataagtagggttagtctaaattgcaggaaaaaaaaaaacaaaaacaactgatgagactagaatctaataacaggtgtgccatagttcttgaaacataatttttctctttccagtcttcatttttattaaaaacaaatcataatagggctaatttgtttataaaatcagctttagtcttatacttggcctgtttatttgtataaagtgcagcaagaataattattttcacataggctttttaaaaattggctttgatgaaacttcgttccataaagaatctcagataagaccttttttaaagctgagccccagccatgggtttgtactgtcaaatgcctatacgagtcaggtaaattcctctcctcttgaggttccataattttggaacacataccaataacatatttattataaataaataaataaataaataaaacctttactcattaatacagggaagacttagttttccaaacaatctgtttctttcctttcctctctttttactataatttattcaaaaggcaaacaagaatctttcaatatttttaatataacatgaaaatcttgttcaagagagaaagacaatttcaccctttgcattggtgtgctattaatgtcaaccccaattcttaataaaaccttatagacaaatctatccaattttcatgcctgaccgtaaggtaagagtctcataaactttttataaccctttacagatttttgttaaagaacagatcagtgctctaagaaaaacctattgtgcttttattccaatgttcaacttatgaaaaaactgaatacccctttaactttagccagtgttcacacatagaatttcttttacaagattaatccttcataaaccttccataagttgctcaaaagtttagctttttcctatcaaacttaaaacaagactttaaccctttaatctaggcaaaaaaaaaaaaaaatccacattcccatgccttcttataatcttttaccaaaaacacattttactttccttacacaccttgcatgtaaaactgtttcctcagtagtttcaattacatgttacaatattaactcttagtaacttttatttttggtgaaaaacttagtaagtaagcaattttaattatgtactaggtgtggggcttaggacaccagacagaagtgcagataaagtctgactcttttcagcattgctaggggttatggctaactccacatgtccccaggccttatgtagaaactaatggctctaaagcaggtaagttgaacaattttcaaaagtcaaagaaataacttatgaccttaaagcattcatcaaacctaatatctgacctgcctaatttagaccaaatgtctaaattttgaagacatttttattttaccaataatctttaaaactatctttatttctcaaagattactaaagttatgtgaactaaaaggcattacagtttttatttttctaacaaaatatttgatcacacatcacacacacacacaacacatataaatacacaaacagtcagaagattctgtagttgtaagatttttcatttgccagtttttgtttctcaattggattactggcttcagggtagagccctttgaggaacagggccaggaaaccattcagtttcaagggcctagtaagcaggcacagctggaaggcaaaacagatcccccaaaattaagggtcccatttttataccagatcttagatcccaaagaggagggaatcagtccatctcccataaaagcccataactgccattagccagccctaaaagtatatttcctacttagtaattagacaccaaagttctctcataatgcgaagtaatttctgatacccccaaatgtcaaaaacatcagacaacacaatgtaaaacagaacagggccttagattttgggagagatctatccactttcaattcctggggtttcatgaggaaaacagaggtttttccccaaacagcgtgtgtggcacctcctctgttttccccaaagagtcccagcctgttagaaattttcttaggtcctctcatgtatgcatcaagagtggcaagaaaacaaaatggagaaaaatgacttttcagttgactgaaaagaaaaactttttctcaagaaaaacaagatttgagaaaaaaccataaaggccttttcaatatacccatagcttgaatatccacttttaattaagctgacttttaaccatagtgctctttttaaaaaagtcttttaaaatttcttattatccaacttttagccaagaaaaatggtcaatatttctggcttttgaactttaccaaagataacttcccaggtgctcagagaaaggaaaattcaagagggaagtcagaagttgttcatggagaggaagagaatcaacaagtggcaaaggtcacacagatatcaaccaaaaagtactcattccctagaccgggaattgagagcctgggctaccactgtaaaatggcaaagccttagctactgagctacagcactgagcagttttcattgctcttcctaggaatctagagtcagccaattttgagcttgcaaaggtttttaactgctctggataatttttaaggctaactataacatgaactccaaaattcctgttcccttgatggtggagaccaagagaaagtaccacccacctggttacaaagtcaagctcccaaggacataaaacaagatgagagggaaacttcatccagttttttttgtttgtttcacaggtctacaaccaggagtttcaacatgtggtctttgggcaggatggttgctctgagtaacagaaaatataggaaagggaaaggagagaaagagagagagggccaggcacagtggctcacacctgtaatcccagcacgttgggaggcc[133 bp omitted]aggcaggagaatcacttgaacccgggaggcagaggttgcagtgagccgagatcgcgccattgcactccacctggccacagagcaagactccgtctcaaaaaaaaaaaaaaaaaagagagagagagagagaaagcattccctgcggtggggaaggtgaagagctcagggaggccagagaaagacctactcattgaagcaacactgaatcaaaagttcaaatggccacttgtcagttgtgaagggatcttttccagcagtcccatcagctctcaagtttccccttttgggaaggaaaaagttccccatgttccacggtcttgtatatgcctaatcctgtcacccacagtcgtcagcaaagagtataagacagattaatccgaagagaatagcggtggcattaatccataatgccaaattcatttttaaccaagagggactttactgagaggggcctttaaccctctaaatcttaggaaggactctaaccttcctaaattgggcctgagacccaagtttggtcaagaagccttgccttttattaagatgggcctttaaccctctctatcttaggagagtctatcctaagttgggcctctaactcaatcccaccctttacccaggtaaaatataccccaccacttacccaaaatcagccagttggtgctgcagtctatttcctctggatcagggggtctcctcagtagagtccctttgtggttcaccaggaagatgttagtggaaaggggtcccaatccagaccccaaaagagggttcttggatctcacacaagaaagaattcagggcgagtccacagagtaaagtgaaagtttattgagaaaataaagggataaagaatggctactccattggcacagcagccagaagcaagaagttctgaactgcctatcagatattaccattttataaatgagaaccagtccataattttggaacatgtttcctatataataaccctttcttagttggaaatgacccagacattcaacaagcatctacaatgattttaagaacttaaatcatacaaaaaagttttacttagaagcatttatctcatttatatgcatataattctcccatttttaaccgtttacttagattacttctgaaaactgagatcttaccacagaggtagtcattattgaaagttaattccctgttaaccattttaaagcttgtgaacatcatgtgttcatctaagtaagaaccttaaagttaaaacacataggcattttgttgataactcagaaggtttagctattttcctcaaacaatattaaatgtcttatcaaaaattacacaaagatcattctgtcttgggctgggtttatagttttgtaactcttatgccaaattttggcacctaatgatatctggcagagataaatatgaaaccgcttgatcaataaactcaaatgaaaatgtatgttgacaattcttaagatatttataatattattttaccaataatgtaaagccagcttatttattaaagattttacttaatttatgagtacgtcttaactctaaggaatttggttccttgtgaccacaatacataacaaaatacatgtacatatgcataaacacacacatacacactcatattaagcaggccgaaaataaacagaggaagatatcacctggctgccttctgcaagggtggcatgaggtagggggagagaggggaagaaagagatgagagaataaagcaatggaaagggagctcaggagccctcctgcagacattgagtggtgtgaggttgatacttccaccaccatcatttatctcccatcagggagagcctcagcaccctaagtctgcacagtgtgggatgggttcctcctacttctgcaagtcactggtcaggcaaactgtttccagccagagggagctagagctgcctgcagctgagaagagtaaagctgtaagcggctctccaaagatagaagggtgaagttggaggtagagaggaaagaaatcagggcccatacacaaagtcatatattcatatatgcaaatagacagcatgcttccacatgagtccccaaccaagggggctgggtgaggtcctgaatccctctccccagttccaaatggctccatgggctgttaagtccagtccgagcacaggtcccatggtgccgcacatacaaataaatacaaatgcattaaaatgctcaaatgatgtcactaacagccaggtcttaagtagagcagggcttcagtgacaccccaaaagagacagagggtggtcaggtgcactgccaaccaaattacccagttccaaagtttgtcagctctttctctttttctcccagaattcatttcccttgcacaggcaatgcattgaaggcagcaaatgttgtgctgggagtggggagcaaaagggaaatttccccataagaaagcattttttgcagctgctgggaagctccctaatgctttcatcgtgggacctgatagccatgagcagctggcactcacaggtgaccccatgtctcatctgatagcgaaattgggtgatcaggcagaagcctacctggagcacagagcatgtccctgtatgggccaccaaaaattgcaaccaaaaagtgggttagttgcttgctgaatgtagagtccaattaacaagagtgagtcctggtactttccagaaaagtgattttatttccaaagctagtttgggggagtgcacaaagtgtccagctttaaatgtactgcttcacctttggaagaaaaagtgggcatttatataatgtaggggaggaaatgagcaagggcagggctcttctgctagccttatctgtaccttatctactgggccgttgtgttgccaccttcctgggcagaagtaagttgtaaaagtggctaagtgggcatgctctgggcatgtcctcctgaggcaacaccctggaggtgggagttccctcttggagcacacagatgaacttgccctgtaggaaatgcctggagagggggaggtgagaagttattttgcacttgaaaaagggctaaatggaaagtaggaggaaaggggaaaggcgaaaagagaaaaaaactgttgcttaggaaaacgggagtactcagttacagttgtgaaactgcctttgcaaaaattatatcagtgagcaaattatgacagtgaaagagatctgatctagcccaccatccctcttgccttttccttaattattcctgggctttggggctgaactaactttggaagatatttaggttatggtttaaatgataatagctctttcccaaaaatcattgtaaagctaatggaaggccatcaggctaggggttggagaggaacctgattctgctaagttttagacatagattgccagccattcctgcagataacaccactactgtagattggccttttgagatatcttttcaggttttttgcatgtctgacacccatggctccacctagactcaccaatcccactcatgtggccccaccctgaggcaattcagcatgcaggaggacagctttcacctcctatgatttcatctctgccccaaccaattagcagcaagcctagccacccccactgcttcccccaaactgcctttgaaaaacccccaacctacaagctttggaggagattgatttgagtactataataactctgtctattatatgc[132 bp omitted]tcccctgcctc[134 bp omitted]gccccccaaagtgctgggattacaggtgtgagtcaccacacctggcctaaactctttctttactgcaatactgtggtctttctttgtgcagtgggcaggaagaacccctcaggtggctacagttgcacaacaatgtgaatatacttaacgctactgaactataaacctcgaaatggttaagatgctaaattttatgttatgcattttttacaataaaaaatgggatgttacaataaaaaatgggatgcaacatatgctcacctttgggtggtccccaggtgtgcatacgttgtggctgtacatgctagtatatatgttacatgtcttacatctccacccaggggtgtgtgtgtatatatatgtatatatatttactattaaaatgagcaaaacgttaccttgagggcaagccaagttgaagtgcacatgcttactgctggggaaagtccctactgaagttatgtcctgccagggccagataagtcccagttagggccagataagcctaactgcaagtccagatatggccattgttttttctgattgctagtggggtaaggtttccagggcttccttactttgaggctgcctttcctgctcatgtctgtctgtctgtctgtctgtcctgctgtctatctatctatctatctatctatcatctatctatcatctatctatctatctactctaacatctggaggttttttttttttgtcttgtggatggaaagatcttaaataaaattttagcaatttgaatccagcaagtatggaaagaaaaatttaccccatgaccaaattggattttccagtaaggctgttgatggtgattgtgagtcctcagttcttgtcttcttggtttaaagaatttaagcaagagacacacagcaagggagatacagccataaaccagtttattacaaaattgaaagagcactctgagagctgagtcagagtgggctgctcaagagtgagacacccctggctgacactagggaagctccctttaggggagttttacatgattattcttaagagggtgggaaagggcattgctagtaagtatgttatgggtggtcctctaggtgcacatgttcggtaactgtacatgtttgttcatacatcacatctcattagcatcttaaatctccacccagcagtgtgtttttcactagtataatgagcaaaaagtcagtccaaggacaagtaaaattaaagtgcatgctttctactggctgaagtccccactgaagttaggtcttgcctaagccagaggagcatgaccacaaagcaagcattgtgttaacacatcctgatagacatggctactttcttgactacgtctcctacttcaacttcaaggtaaagatggttaatgttaatacatctatctgtttatttcactacatcaagaaataaaggagaaaacgacaaaatcacatcaatggatactaaaaaagcatttgacacaatttggcagtattctcaaactaaaaccagactaaaatgggaatatgaaaattcagaaaagattacaggctcaaaatcaccaggaagcctattactaaaaggtaaaatgctgaagttgctaccagtaaaactagtaatgacatacagttgttcctatcacaacggtgttttgaaaaagctctagctaatgcgatgaaatatgaagataaaataaactgattatatattaagaaaggagaggtaatcatttttatttgcagatgatatcattggaagggtgttcatgctatacagtgaaagaagttgtggcttcccacctcacagagcagaacagtggtgcttccctgggaagaaatggcctgcactgctgttagagtaggtagataggcagatatgagcagaagaggatagggccccaaagagtgtcaagtgactctcagttgactgtcaggtggttgtcaggtggctggtaacagggaggggaaaatttcctaacaaacaagagacatcttgagcttgttggcaacaatttcccaataagaacttaaaatggcaaagtttgatcttcctctgggaacatgtccaggcatgcacagtaaggggcaaaatggtggagtctgacctatatatgatcttcctccaggggcactagaccagtaagtgaaaattgccctaagacagcatgcacataacttcaataattaaatggctcatgccgcccctcccagatactggcaagtcactgtgcctgtggtgattagccaacagcctatccaagaggaaggatgagactgggaagaatcaggaaatagtaactctatattataattattatataagagccctgagccaacaatcaggtggggcgttccatcttttgagttgcttgcttggttcctttcaagtgtactttgcttcaataaactctcatttctgccttaaatctacttctgtttctcagctgaattctttctctcaagaagacaagaattgaggactgtagaccctgcccagactcactgccagtaacacttctttgggtagacttcctggtggacagattcatcctctccttggtgatactactggatgtgaaaggatgcagtgggagtggtacagtccccatccaggagataccatgaggagagaggggagataaatcagagtggtactgtccagtcccactgtgttggtgatgggaggagagcgatgtggttggagtaagaacctaaacatcctcataatctccatcagctcccccacaagccatctcaactgaaataataataggtatcaattaaataagtcttaagttgatatggctactagttgttttctttaatatgtgtcaacaaaaacatcttttagaaaattttattgttcataattcctatggaagcatagcattaagacacatttctgaccctgccccacaaccagtttgctgcctcttagcacctcaaatagaaaattatggagatgccagtgcccctctgggagatgtcagaggggcagaggtaataagaatccatatatcccctcaatggatgaactgctacatattctgcaacacccagttcaagtacctcctatgagaagccctacctgactgtggtaggagactctatgctagctgaagaaccttttgacccagcaagtagggaagacttttttaaagggcttgttcctaagctctggtgtcctctatctttgtgccctcagatcagtcacaccctttttggagcccagttcaacattctagacattagagggttagaatctaattatcacatagttccctgtctttcctacagccctggattggataattttttatttggtgaatgatatggtttgactgtgtccccacccaaatctcatcttgaattatagctcccataattcccatgtgttgtggaaggacctggtgggagataattgaatcacaggggcagtttcccccatatggttctcatggtagtgaataagtctcgcgagagctgatgattttataaggggtttcccctttcacttgtctctcattctctcttgtctgccaccatgtaagacgtgccttttgcattccgctttccaccatgattgtaaagcctccccagccacatggaactgtgagttcatgaaacctctttttctttataaattacccagtctcaggtatgtctttatcagcagcatgaaaacagactaatatagtgaacaaataaaagaagaaattgaatcagtggaagcttgctaacacacgtatacatatctaaaaatgtttcaggcacaggagaggaagaggagaaaaagaaaaggaaagtatcctaatgttatgttagaggtttatactgaagtgtatggatgaaatgatatgaagtctggtattggctttaaaatactcaaccaatggggctgtttaactaggggtggagaagtgaggaaataaaatagaacgttgataactgttgcagctgagttttgggtacataggaagtcactattctatttgatctactttggtgtatatatacaaaaagtttacagtgaaaaggttttaaatgaagaaaagaaatggatggaaatattcacaagtaacaatattaacattagacaaaatatattttgaagtatagaatttaaaaagggataaacagaggaagttcttaatttaaaaccatgcaagccaccaagaagacgcaccaatcgtgagcatttatatgtgtgtgtatgtgtgtgtgtgtgtgtatgtacttttgaaatacataaaacaaaaactgacacaaatggggaaaattttgcgagtattcagttacaaaggaagaataatatatctcacagaaactgacaagatcaaatagatgaaatatgtaagacacaaagactggaataatacaatcaataaacttggtatttgatatagctatattcaatctttattttgtactcaagagaatgcacatgttttaaacatgaacaagacacccttaaaaatccttgcactagtgcaacaaaataataaatctttaaaatgatatcacaaggcaatattcataacccacaatgaaataaaaatggaggtaaaagcaaagagacaataaatatttcaaatacctggacattaaaagcactcacatacaattaatacttgggttaaggaggaaattaaaatggattaccaactacctagtattatgagagcgctacatataacatctatgggctgggaaaattaatatacttaagattatttatatcataaaatgcatttattagtaagcaagaaattctgaagatgaattatctaaacttttactacacactgtaggaaaggaaaatgaaatacccacaaaggaagtaagtaaatgttaaaaacagaaattaataaaataatgagcaaaacattactaatcagggaattgcctattgagaacataatgaaatactctcttatatccattcatttggtaaaaataaagcagttgggcaagattaaatgttggtaaggatctcttatacagttttggtgggaatgtaaattagggaaaccactttggaaagaagtttagcatttccttctataattggacattcatacacctcatcacacggcaagtccactcccagaaatagccccaagagaagctcttgcccaggtgccccacaaaatatgtaaaaggacattcatgaaagcctattcatgtcataaaaacctggacacaaaccaaatgctcaccaaacgagtaaaaatgaacaaactacagtaatatttaacaacacaaagggatgctaagtgaaaaagtgtaaattgccaaagattatataaagtatgatacattcattacaacattttattatgaacattttgggacataaagaaaagctaaaagaattttaaagtgagtatgcacaaaaccacaacctaaaaatctataacaaatatttcagtatatttgctttatctcatatctattcatacacatatctttcttttcattcatcaacgcatcttctttttttgatgcatttcgaattatgttacagtcatcagcacacatcacccctaaagtttcaacatgcatatcataaactacagtttagtatttgtctatattctaaggcaaaatttacacacagtaaaacacacaaatcttatgtgcactatttgatgagatttaacaagtgaacacagacttctagtttcagctctgacatgttaagagcttggaagtaatcactcccatccttgcaaaaataataaaggctgaacaaactgaaactcaatgacttttcataggccgtcagagagtttaggtcacaaggcaaactgccacccccaaatctggagagacagacaaatacagagaatcacagctgagatcagcttactttacctggagcagaagctgctggatccctaagcagataggaacacttcactggtgattttgacaaattgctagaggctgaatatgaatagcttgagaatgagaaacctcttatggaggtctcacgctttcctgggttttacctccagaaagccaagaaggtcctcagatgaagatctaaagacaatcccctcacgtttctggcaagaggagggcaggagggtaagagggttcaagttgccattttgaaacacactcagagctttctctataacgaaggactgctctctaggggaagaaatttttccagagacttgtctacctgggtgaagggcacccagtcaaaaacatcctgtataatctaaggggagaaaaaaaggctaagaaatacttttgaaggtcacagcccagagactaaggcccacaaaaagagtgagatttaatcataagataatggaacatttcctctctttcactccttactactgcagtataataacagtgaattaaaactgaaagagctgcaagacacagaccctatttaatgaaggcgttcttagggaaactcaaagacaccaggggagggaaaaaataagaacactggagaaacctgaagcctctggcatctagaactacagcaaacattaaacacagaccagctcctagattaacataaaacctcatactaaagatctgtatttgttagatacctgatacatcatgtccagcattcaacaaaaaattataaaaccatgctaaaagacaagaaaaaatatagtctgaagaggcaaagcaagcatcagaaccagactcggatatgacacagattttgaaattatcatgtagggcatttaagagaactatgattaatatgttaaaggctctaatgtaaaatgtggacaacatgtgaaaacaaatgggtaatttaagaagagagataggaactctaagaaaatcaagaggaaatgctagaaataaaaaaacactataacggaaatgaaagaatggcttttgtgggcttgtaagtagcctggacatagcagaggaaagaatcagtgagcttgaagaaaggtcaatagaaacgtctcagattgaaaagcaaggataagaaaaaatgaaaaaaaagcacaacagaatttccaagaactgtgggataattacaaagagtgtaaaatatgcataattggaaagcaaaaagagaagagaggaaggagcagaagagaaatatttgaagaaataatggcaagaattctacaaaattaatggcaaacaccaaactgcagatccagtaagcaggatgtcttagtccacttagtgttgttataaaggaatacctgaggccgggttatttataaagaaaaaaagatttatttggctcatgatttggatgattggaaagttcaagattgggtatctgcacctggtgagggtctcagggtgcctctactcatagtggaaagctggcatgtgcagagatcacatggtgagagaagaaggaagggagagtgggtaggtgccagactcattttaacaaccagctctcctgggaactaatagagtataaattcactcatcgatgagagagagcattaatctactcatgagggatccacctccatgacccaaacacctcccattaggcccctcccccaacactggggatcaaatttcaacacgaggtttggagggaacaaacatccaaaccatagcacaagataaataccaaaacaatctacactagtcgtatgatagtcgcactgaagaaaaccaacaacagagaaaatattgaaagaatccagaggagagggaatcttaccactagaagaacaagattaagaattacattggactacttgttggaaaccatgaaaacagtaagagagtggagaggcacacttaaagtgtcaaaaggaaaaacccaacaacctaaattctagatccagtgaaattatccttcgaaaatgaaggagaaataaagactttcagataaacgaacactgaagaaattcattgccagtagatctgccttgcaagaaatgttgaaaggggttcctcagggagaaggaaaataatctaggtcagaaactcagatctactaggaaggaagaggaagaataattaaagttaaaatattttatttttcttatcttattcttaattgatctaatagacaactgttcaaagtaatgtattatatatacgattatagcatatttataagtgaaataaatgacagcaacattataaaggatgagaggaaggaattgggaatgctcagctataaagtacctgtacaacccatgaagcagtatagtgttagttgaaagtggacttagattagttgtaaatgtatattgaaaagtctacggcaactgctaaaaaatatttttaaaaagtgtaattgatagaggagagaggagagaaaatggaatcatataaaatgattaattaaaaccaaagaaggcagaaaaaaggggaagataaaaaaggaaaaagtacaagtacaataaatagaaaacagtttaaaagatggtagataattaaactacatcaatcatcgccttaaatgtattagtctgttttcacactgctataaagaactgcccaacactgggtaatttataaaggaaagaggtttaattgattcacagttcagcatggttggggaggcctcaggaaacttacaatcatggcagaaggcaaaggggaaacagggaaccttcttcacaaggcggcaggaaggagaatgaacacaggaggaactaccacacacttataaaaccatcagatcttgtgagaactcactcactatcatgagaacagcaaccgggggaaccacccccatgattcaattgcctccacctggtctctcccttgactgtggggattatgaggactacaattcaagatgagattttgggtgggggacatagccaaaccatatcaaatgtgaatcttataaatacaccaattaaaaaacagggagtgtcagagtgcataaaaaaccaagacccaactatatgccaatctataagcagcccactttacatataaatatacagatagtttaaaagcaaaggggataaagaaaggtatatcctgctaacactaagtttagagcattctaatttaggaacattaaacaaaaacattcctaaatgaaataatagcaaatagaatccaatagtacattaaaataataataatatatctgtacatctattatatatcaataatttttttaaagaataatacatcataactaagtaggactatattagggttaaagggaagttttaaaatttggcagtatattaatgtcatgttaactgaattaaacataggcaaaattcattgagagaaaaaccaatacacaggattttaataacatgaaagcatgctcaaccaccctcatactaagacaaaagtaaattaaaactacacttgagatatcatttcccacctcccagattggcaaaatctaaaagcttaacaacccatacttttggtgaaattatgagaaaactaatactctcatctattgctggggtgagtcaaaacaatacaatcctatggagatgaatatggcaatattcaatagttcagttgtttctcagtagagctcaaataaattaatgaaatcaagtcatcagcatgattccagtcactagaatcaagaagcatgaagatattagattagaagtaagaaaaaaatgtggtttcagagccaagacaaacatctgaggaccagtatatctgacatactgcaattggggaagaaaactgcaattgatgagtacagattatgtgtccaggagttctagtagaatattatagcagtacttatcatttattcattgcactgatatttcttaagcactaattgtgtgttatacaatgtatctgcaatcagaaaagcagtaaatctgatgctgggacatgactataattattctaaaaaaaaaccctacatgcacagggaaggaaaattctttaataaaaaatgccagctaatacagaaaaataatagaattagagaagcacattttgccaccctaaagttaatgattattttaggcaaagatcatcaatggacccaaattaaggttgtcgaggtacaaataatttgcaaaagttttactggaagccaaatgtgaggatcaacccaggaagacacaccaacaaagttgatcatgttcaagtttgccacaggctgaagggcttttatgggaaaatttagaagaagggagaaggactcttcatgtcagagttgtcctttttattggagggtgtaatatagaggttataatcattaactatagattataacacatatgctaaaatgttctacacgtaagacaatcagtaaaactttatgacttagcaaaaaatttgtaaaacatcatgatttggaaacaaattagtgtcctttttagtgtcagtaggttatgtattaatcagtttgtcaatagtttgaggaacttataagattttttactccagggacaggaagtaagccatgaattctaagacttccctgggtgggttaatttggaagcctgctaaatgtgacctgtcagttataagtgctaaaaccatttttgtgaatgcttcttggggaacagattattcacagggttcccaaagaatgaccccacagctaaatacaaagggcagaggtggctttttttgcaatggagagatttggtggtccatcccttaaccaagaagtcaaacttagtataatattaccaacagagtgaagtgacacatgcctccagatatgacttaccgagagggacacatcacccatgtagttttcttttccaagtcgtttggcctgaatccgtttttgagaaaacagaaatgcagaaccatctgtaactgtaaccatctgtaacaactgacataagcccttcaaaaatattaacattgtgacagacaaaaaaggctgggaaactattatagattaagactaaagaagagattagagactaaggagatacgacaactaaatgcaatgcatgaaccctgtttggatacaggatttttttttttagttgtaaaaaaaaaattggagctaactagaaacatatggaatttggactgcataatatttttgtatcattgttaaatttcttaggtgtgatgagattttttttggggggaggtgtcatggaactgttctgtatgctgatggtggcggtggttacacaaatctacacatgaattaaaatttatgaaactggtctgggtgtggtggcttatgcctgtaatcccagcactttgcaaggccaaggcaggaggattgcttgaggccaggagtttgaggctgcagtgagccatgatcaggctactgaactccagcctgggcaacagagcaagacctccacttaaaaataaattaattaggctgggcatggtggtttacgcctgtaatcccagtactttgggaggctgaggcaggaggatcacttgaggttaggagttaatgaccagcttggccaacatggtgaaactccatctctactaaaaaaatacaaaaattagctgggcatggtggtgggcacctgtaatcccagctactcaggtggctgaggcaggagaatggcttgaacccgggaggcagaggttgcagtgagctgagatcaggccactgcactacagcctgggtgacagagcgagactccatctcaaaaataaataaataaggaattaattaattaaactgtacaccaaaaagtcaatgttactatatgataatttaaacataaaattttaaatcgtttaaaaaaacctctcaaatttcttaggggtgagaatgggtttgtggctatgcaagaaaatgtccttgttcttaggagagtggaaatctacacagatgatccaatgagaaaaagcagagacttttcagagcttactacagtaaggtattgggccattatcacttggcgtttgtcaaagactcaaaggcaggcagaagaatgggaaagctttatatgtagtagaaaaaggggaaggcttcaggtgtgtcctgattggagggtgttggagtgcacaagctggaggtggactaactgaagtggggcatcctatgcgattgatttgggaagtagatttggctttttctggttggccctgagttggaaattgggttaaaaaaattgagaagctagatgtcatcaatcaaatcctgaccatctgggctgattgctactgaggttgtggtttggcttcccatgcttattgctgtagaggttgtaggtcaggattctattgttatatatggtctggccattgcctgtttgtatattcagtccctcaggagatacatgctgagtatatatcctgctgagtataaggagcatgatgtctgcagcttactgtacaaaggtattgtaaaacaaacacggtggagtcctcagtttctctgttgccttctaccttgcacctttcatccttttttgctatctctcccctgcccccatgagctctgactagcagataagccacaatgtttgcaaaagtaatcctctaaaaatactgtcctgaagggttctgattgagcaaggggcacaaaaacaggaacgaccctgccaccaactacgagtttcacttaaagtcaaaaactgctatccaggccaggcatggtagctcacaactataatcctagcactttgggaggctgaggcaggaggatcgcttgaggacaggagtttggtatcagcctgggcaacatagcgagaccccgtctctctctagtgtgtgtgtgtgtgtgtgtgtgtgtgtgtgtgtgtgtgtgtgtgtgtgtgtgtgtgtgtgtatacacacatacagctacctaagccaaaagcaagaacacatattccactttccctcataaaaaccctgaccctgcttcaatcaggacatcacctgatgcacctcagctgaataaagcctttaagctctatagcagtcacttcaatcattttcttttgactctgtttttaaatgatggggcctgtatatatgcaaacagaaatataaggcaaatgtgacatagatgaacaattgttacttctaggtggaaggtatttgaatattcatagtgcaattctttcaacttttgtgtaggtgtgaaatttttccattaaaaagctgggtgtaaaataaataaggtattattgcttgctatctactgaagtatgtaaatggttgtggttattggtcctgaggtccctgctcagccattgaacctgatacttttcacaaaggtttctttgacttctgtcagtggaagactttgtaaaatgttttcccctactaaagggaggcacacaagacaagagtgaccaggagaccttggctgtggattaatttttgcatctgctctaggacacaggtgctcatcattatgtccttagctgcagatataaaaatactcgaactctgcattcttcttggttttcaactgggtacccacatagatgtaaagaatcccgactgacctctctatttaaagtggcagttctggaaatcagtatatggaagaaatacctgcactcctatgtttgttgcagcactgtttacaatagctaagatttggaacccacctaaaggtccatcaacagatgaatggataaagaaaacattgtacttatacataatggaatacaatttagccataaaaagaatgagaccagtcatttgcaacaacatggatggaactggagatcattgttaagtgaaataagcgaggcacagaaagacaaacatcgcatgttctcacttatttgtgggagctataaatcaaaacaattacggagatagagagtagaaggatggttaccagaggctgggaaggataatggggggctggtggggaggtggggatggttagcaggtacaagaaatatagttagaaaaaatgaataagatctactatttgatagcacgatagggtgactatagtcaataataacttaattgtgcattttaaaacataatttaaaacataattttttttgagatggagtctcactctgtcgcccaggctggagtgcagtggcacgatcttggctcactacaacctccacttcccgggttcaagcaattctctgcctt[134 bp omitted]gcctcccaaagtgctgggattacaggtgtgagccactgtgcccagccaaaaatttttttttaaaataaaaactaaaaacatgaagtggcagttctcccagcatttccaactcataccactcccctataacataccctctttagcggttgtcacctttgtaatttgctcttttaaaatgcttattgcctctattccctgctaggatgttaactccatgaagttagggatttgggggctgttttgttgaaccaaacatcaagtaccaagaacagtgccggatggtcaattcatcaagtatttataagttctccatctctttggtatttcatacattacttataccaaattaattttattatagcagtcatgtcgtccagagatgcctgcagagtcttttggggaaatcattaatattttaagaaaatgactctgaagtgcgtattttgctgccctctacattgtataataaagatactagaaataaagcagttgattactccatatatgtaagaagcagaaatcactgcagtatcagcatgaacaagtaaatgagcaaacagtaaacaaatacaataatttctgatacaaaggaaggctatgaagaaaactgaagcctggcgaagagctcaagtgttgggatagaccagggaagaaagacctctgaagaagagacatttgagcaggtaagtgactcgatagagtgacccatggagccaggggcagcagtaaatgtcaaggccatggagcacctgcctccctgttcatcccaccactaggtggcatctctgggctgcagccaaatgttttcttgccccattaaagggagagatgccacttttctccatacagattttttctttttatcagttagatatttatctgtattagtcagggttctctagagggacagaactagtaggtgatatatatatgagtttattaagcagtattaactcacacagtcacaaggtcccacaataggccatctgcaagctgaggagcaaggaagccagtccgagtccccaaagctgaagaacttggagtccgatgtttgagggcaggaagcatccagcaggggtgaaagatgtaggctaggaagctaagccagtctagcctcttcacgtttttctacctgctttatatcctggctgcgctggcagctgattagatggtgcccacccagattaagggtgggcctgcctttcccagcccactgactcaaatgttaatctcctttggcaacaccctcacacacacacacaggatcaatactttgcatccttcaatccaatcaagttgacactcagtattaactatcacattatctaacatcttaattttcccaattaatttaaatatgtagttacttttaataatataattagctatgatcgtgccactgcaccccagcctgggtgcagagtgagactcagtctctaaaatgaatgaatgaatgaatgaatatatgcacctaccacccaaaagaaaaggtacggacttgatgataacctctatctatccatggagtcccccaatttgttgccttgcccccaccctcaactgaggtaaatatcatcctgaatcccaagttcgtcgtttttaaatttctttttaatgtaattttattgcaactacacaaaatcctaaatagttcatatcctttatattagtagcttttttttttttttttttaaagagacagggtcttgctctgtcacccaggttggagtgcagtggcactatcatagctcactgcagtcttgaactcctcaagaggctcaagggatcctcccacctcagcctcccgagtagctgggattacaggcacaaaccaccacacctggctaatttttaaaattattgtagggacggggatctcactttgttgcccacactggtcttgaattcctggcttcaagagatcatcccaccttggcctcccaaagtgctgagattacaggcatgagccactgtgcccagcctatattagtagcttttaagtttataaaagtgtgttatgctttatataatcttttgggattacagttcctcccccttaatattcatccatattgttgggtgttgttctagttcattcattatgactcctgttgatgagcatccatttttttttccaggttttgctgttgtgaacaggatgccatgctggtatggcttgaatatttgtcccctccaaaactcatgttgaaatttatccccaatgtagcagtattgagaagtagggccttcaagaggtgattgagtgttgaggtctctgccctgccctcatgaatggattaccccattaatgagttaccatgggagtggaactagtgactttataagaagaggaagagaggccaggtgcaatggctcatgcctgtaatcccagcacaaggtcaggagttcgagaccagcctgaccaacatggtgaaaccctgtctctactaaaaatacaaaaattagctgggcgtggtggcgcgcgcctataatcaggaggctgaggcaggagaatcgcttgaacccgggaggcagaggttgcaggcagccgagatcgcaccactggactctagcctgggcgacagagaaagaatccgtctcaaaaaaaaaaggaggagcgacctcagctagcatgctcagccccttcactgtgtgataccctgtgctaccttgggactctgcagaaagtccctaccagaaagaaggccctcaccagttattgcccttcaaccttggacttctcagcctccgtaactgtaagaaataaattccttttctttagaaattacccagtttcaggtattctgttgtaagcaacagaaaacagactaagaaacatgcatatcctaggtttcttgtgcaagtgtttctcttggttacattcatgagagtggactcactggattgttaaggtatgtatatattcactgtaggagaaaatgcaaaaatattttctaaagtggttgcactgatttacattccttcaacagggcaaaaagatcctgttggcccacatactctccaactcttggtattgtcagacttttatgtttttgcaatttgaatgggtataaaatgtcatttttatcatgtcttgatttgtatttcccttatcacaaatgactttgaacatctctttatatgtttgctggctctatatctccttcttctctgaagtggtctaacagaactttcttttttttttttttttggtactattatgacatccaagaacactaacagtgattcttggcactctattagaagtgtatgcatgccaaatatgcttccactgattccattcttctttcatttattcattcaacaaacatttgcccagaccagggatgcaggggcagaatgacaagctgggataatcaaagttcaactgctatggttcaaatgtttgtctcctctgaaactcatattgaaattgccattgtaacagtattaggaggtggggcctttaaaaagtgaataggtcatggaggctccattctcataaactgattaatgctgtcactgagggaatgggttagtcacctcaagagtgggttgttataaagtgagcccagtcccttgtgctttctctttgttcatacacttgcttgccctcttgtcctctgccatggaataatgcagcaataaggccctcaccagatgctggcaccaagttggacttcccaatctccagaactatgagccaaataagcttattttctttataaattacccaatctgtgatattctgttacagtagcagaaaatggacaaagataccaactctctaaaaaaattaaaatgaaaatcggactataaaaatctgccttgctattcatcaggatggaagaacagacacatataaagccaaatgcaaaattcacaggaaacattatttcttctaaggacaggctgcagttgtaatgccataaagaacccctactttaagtgcctattgctttcttggtcaatgagaaactttgttctctacaatcatagactatcagaaactttgctgtttgaaatgatatcagtaagagggaaacatctgattctcatgggagattctaagtcacttccagacagagaagcaagattcaattttcaacccaggtgcaaagctttaggcaagagttatctggggacacaaaattctacatctaaattgtttccaaggaaacagcactctgggttcacttcacagtccagacctgacaattaccctttacatacagccctgctttcctttgagcccactaaaacactgcttcatttaatttcatctgaactccactattcctcaaaatcctataagaactctatcttttcctttgcttagtgagctgcccatggtgcccctggtgtgcagtctcccttattgattgctggatctgtcagactaaaaattagtttgaggctaattggactaggacacctctaaccttcgagattgttaaaccgagggccagaggggataagactggattgagagcccccagcaagtccacacttcagcctacaccaggtcctctcaaaatatttttttcacctgaggattcagaaaggctttcaggagggcacacaggcttctagctctgtcaggattctctggaggaggagatatttgaacttgattttgaaggatgaataggcattcttaggtgaaggactgcacgacttcttccccttctgctccagtgacatctcccagagggcaggggcatctccagaatttacacattggaggtgatatggagcagcaaactggttgaagggtagaagcagagccttgtattaaagctacatttccaaagtaagggcaccatgaccacatatattttacttcatgaggaaataaaaataataaagtttcctaaagatttttattgacatattgcattggactaaggacacattaaaaattattagtattggtactacgtagtccctttttagctggggtagatggagtgggagataaggtaaattgctgcagcattcaaacctcgcatccaagccccacaggcacagcaggaggggaacccagcactctgagttctccctttttcccacctcatggcatatcctaggagggcttgcataaccatgatttctcctcctcctcctccccttgtggtatgtcctaggagaagcctgtaaccagcctgacatctccccgcttctcatcctgtggtatctgccaggagatagccgcggccgcccctgattctttccaagaggcccttcagtttctcggagcggtatcacacagatccatagactacaggtccaaagaccccctcctccagttagcccgcccagagaaacgtccccacccgtgctccctgccaccagcgggacagctccacctgagtttagagcagacagctctaaactcacagcctgctctgtgagttcagaggtgtcctcatcctcaatacggatggacactcctccaacatggtgtatcccatggggaagcgcgacgtgggcgcggccatgttccccacctgaccacgccgccgaggggtaccgaacgtcccaaagcacccacttccgtaacttctccatgttgactcctggctaacagcagcttcaaaggtggttttgcgcacgcgcggaacctccgcttccctcattcatgtgaagtcccaaaccccgaaaaagggcggtgctaggggtagtgaccggaagcggctgcggttctcgccggttctcagccggggtttgatagttgtcaggaggattcgacgttcagtgcccagggatgtggaggtgatggggggccggggagggtgagtgctgggcgattctgtgtggccagtgatggaatcgtttatctaacttgagttggatgattcactcatcattttgcaggcttttctcttttctaacatcaccgttaaggtcttaaagttcattctaagccccattgggtttggagcattatgttttttaagagtgttaacttgtattcatttgtcttttacccgggagttattcaaaagtggggtttcagtgtgcaaaagtttatctctgtaatggatctctaaccttagttttctgtgttagaaaaatatctacgtgaagctcattccttgaaatataaggagacttatggcctagtccgtggtgaatttttagaaacgttctatatataacttgaaaataatatttaattatttagtcgtcaattgtgtcatagaaaatctatccttttttgtctgcttcttctattacttcgaggagagagaaattctccactgtgatggtgatttgtctgtgtctccttactgctgtctgtgatcctctgtgagttactttttgtataaagtatgagacttaggtcgaggtgcattaatttgcttatggatgtccagactgaagcaccatttgttgaaaagactatctttcctccattgacttgtctttcaccattgtcaaaaataagttggccatacttgtgtgtgggctctttctgggtttgctattcagttcattgtctatgtgtctatccctctgccagtactaccttgctgtcttgaattggatagagtgattcctctcactttattctttttcaaaattgttttaatgcctctggttcccttgcctttcctatatgcattttagaaaatcttgtctctatctacaaagcatcttgcttggattttgataggaattgcattaaacctgtataccaactcgggaagaagttaagtcttaactgtgccaagtcttccaatccatatacatagtatgtctctctatttatttagatcttttaaaatttctataaatggtgtattttaattttcatcacccaagttctgtacatgtcttattcaatttatacctaagtatttaattgttttggagtggtcataaatggtgttatcttttaaattgttgcttatatataggaatacaattgagttttgtctgttggtcttgtatcctgcaatcttgctgagctcaattattaggttttacaccttttttggcagattccttggattttctgcatgagcaatcatgtcatatacaaacagggatagttttatttctttctttccaatctttatacctctgcttttcttcccttattacactggcaagaagttccagtactatgttgaataagagagtggacatctttgcattgttttcagtcttagggggaaaatattcaaccttttaccattaagtatgattttagctgtagggctttctttttttggaccctcttttttggttgaggaagttcccctctatttttaatttcaaaagtagtttttatcgtgaatgggtgttgaatttcatcaacactctgaattttgatgatcttgtgattttttttcttttttagcttgtcagtatggagggttatgctgattgatttttgaatattgaactagtcttacattcctggaataaaccctacttggttgtgatgtataattctttggatatattgaaggaattgattagctaatgcttttttgaggatttttgcatctaagttcatgggaaatatttgtctatagttttcttttttatactatctttgtctggttttattttttatttttgagacaggctctcactctgttcctcaggctggaatgcagtggtgtgaccatggcttactgcagccttgacctcccagcctcaagtgattcttccacctcagcctcctgagtagctgggactccaggcacacgccaccacacccaactaattttattattttttgtaaaccgggtctcactatgttgcccaggctggtctcaatctcctgggctcaaatagtcctcctgcctcagcctctcaaagtgctgggattacaggtgttagccactgctcttggctttgtctggttttagtattagggtaatactggcctcattgaatgagttggggactatttcctcctcttctgttttctggaagagactgtgtagaataagtactaatttttatttaaatatttaaatatttggtagacttctccagtgaagccatctgggcctggaaacttccatttggaagctttttgatcatggcttcaatgtctgtaatagttatgtaactattcagattatctatttaatatcattttagactacaggttaagcatccctaattcaaaaatctgaaatccaaaatgcttcaaaatccaaaactttctgagtgccaacataatgccacaagcaaaatttcacacctgattttgtgacaggtcacagtcaaaatgcagtgaaaactttgtttcatgcacaaaattattaaacatgttatataaaattaccttcaggctatgttataaggtaacatagtgtacatgaaacataaatgaattctgtgtgtatacttgggtctcattctgcaagatactttattatgtatatgcatatattccaaaataaaaaaaaactgaaatctgaaacacttctgttcccaagcattttggataagagacattcaacctgcatttaatagtgggtgaattgtggtactttgcattttacaaggaattggactgtttcatccaagttgttgaatttatgtgcacaaagttgttgtggtattcccttactatccttttaatgcaagcttgtccaacccgctgtccgtgggccacatgtggctccggacagcttggaatgcagcccaacacaaattcgtaaactttcttaaaatattgtgagttttttttgcattttttttaaagctcatcagctatcgttagtgttagtgtattttatgtgtggtgaaagacaattcttcttccagtggggcccagggaagccaaaagattagatacccctgttttaatggctgcaggatctgcagttacatctctgtgtttcatttctaatattggtaatttgtgtcttcatgtcttctctctctttttttttttttttttgcagagacaagtgaacatttatttttgtgcctttcttcctatgtgtatttcgagtctttttcaaaacaagtccccaggaatctccagattcaattatgtccctgggcttggtcgactgctgcaggattcttaggaagcattatacaaatgctagagttactcattaaccaacattaaaccctaggatagaagatgcagcaaagcaggactccttcctccgtggaatgtgctgatttcagatgaggccgcagccaatgtagaaaatgctggaatttttccttgaaactggactgtgatgagaggtgcttgccatgaacataagctactgtcttttcttttctttctttcttttctttttctttttttttttttttttgagacggagttttgctgttgttgtccaggctggagtgcaatggcgcaatctcggctcaccccaacctccgcctcccaggcaggttcaagcgattctcctgcctcaacctcctgagtagctgggattacaggcatgcgccaccatgcccggctaatttttgtatttttagtagagacggggtttctccatgttggtcaggctggtcttgaactcctgacctcaggtgatccgcccgctttggcctcccaaagtgctgggattgcaggcatgagccaccgcgcccggcgagctactgtcttttctttgacccttcctttccagtttttgaagataaagcaggagataaacttctctgaagatacttgataaaaattccccccaaaaataaaaacacatgcttccacttcattgatacaaatttactgcagtttggcacctgggtctagttcagctggtggatgagcagattgatgtgttcaccccgatagccaggtgtgcccgtctccttgaggaagcctactctatttttggtagcatgacgggccactgacaggtggaaagggctcaagaaccatgagatctcctcgaaatgtttccctgggaaggcaatttcatgaatgaggtcttccaagcaaatgacaccaaacttccccaggtgctcctcaatcactgtactgtctgtcagagggatggtcttattcttgaccttggcttgtctatgtttaaaaatgagttcccggacagacttcagatttggaaatccccaggtcacataaggttccactatatgcagcatttttaggttctgggaggtaacttttacaaagacaccactaaaaattttctttaggcggtcttgcagtggttctctgcaccagtaaactcacgccatcaatcctttcgatgtgtatgacaaaggccaaggaatgtttatctggcaattccaaggcatgaggtttcacttctagtcgtctgagacgcaccttgtcacgtttctgccgccaggaatcatgtaggaatgattccagtcacttaaacctaagcctttttcctttcctctgctccttctttgccaaaagtgcctgctttgcctgggtggctttgagggcttgataaaccttcctcttttttcaggagattttctggaaccaaagggatttttctttgctcttgctctgccatctttctagtcgtgtcttttttatctttgtcaatcttgctggaggattacaagttttattgttcttttcaaaagaccagctattggatttatttattttttctattgtttttctgttttcaatttcattgatttctgctcttgtatttattacttccttccgcttagtttgagttttctttttctagtttcttgaggtgggagcttagattattgatttaagacctttcctcttttctcatataaacatttagtgctataatgttccctctcaacagtgctttatctgtaccccacagattttgatatgttacatttttcgttttcattcatcacattttaatttcccttgggacttcatctttgatccatggatcatatagaaatatattatttaaagtatctggagattctcctgttatctttctgttgttgattgatagttctatgctattataatcagagaacatactctgtacgacttcaatttgtggaggtgttttatgacccccggtgtggtctatttggagaatgttcagcaggtgcttgaaaggaaggtgcattccattagtgtttggctggagaaggctgtgtatcttcaaaaaggttttctgttcagcgaagtcacctttttcctggtccgttaacaggaatggcttttcttggagccatattgttttggcggggggagtctgttcctgttgatggttctgagttgtaagtttctgcagtaccttttgatgatatatgggaggataaaggaaaacccagggaactcaaccactgtgctgttcaagtcctgaggtctgcaagctgtcctccttacctttctacctttcagagtcttctgatttgtgtttgttgttttaattttttttctggtctcttctacatgtactaacctcttctttcttttctgtgttttggttttgttttgtttttttgatagagtctcactctgtcacccaggctggagtgcagtttgtgtgatctcaactcactgcaacctctgcctcctgggttcaagcgattctcctgcctcagcctcccgagtagctggaattacaggtgcgtgccaccatgcctagctaatttttgtacttttagtagagacggggtttcaccatgttggccaagctggtcttgaactcctggcctcaactgatctgccagccttggcttcccaaagttctgggattacaggtgtgagccaccacactcggtttcttttcttttcttatattaactttgttaatttgcattttactagggaagcacttgttttatggcagtattaaaatgcattgctatacagttatgcataatgttctgcaataactgctttaaacaccttcctatctgggaaagattttcctctcattttgaatatatgtatatgtgtatgtgtgtgtatggtttctatggttttaaggctcttccatgatgtaataggtatctgtacttcttttttattaccaaataatactctattgtatatatatggcaaattttgtttatccattcatcacttgatggacatttggattatttccactttttggctattatggataatgctgctgtgactatttgtgtataagttttggaatggacatatgttttaatttctcttgcatagacatggtctcctaatcaaatggaagatttgggttttgatttgtattttcctaatgactgatgatgataattatcttatgttattcctatatctacacacacacacacacacacacacacacacacattcttgactcctttatctgatttgctagagagttttttttatgacattggtcatttccatttgtttattttttttgagacagtttctcactctgtcatccaggctggactgcagtgatgcaactgtggctcactgcatcttcgacttcccaggctcaagcaatccttccacctcagtcttcctgaatagctggaactacaggtgcacacaaccatgcctggctaatttttctatttttttgtagagataaggtttcaccatgttgcccaggttgggctcaaactcctgggctcaagcgatcctcccaccttggcctcccaaagtgctgagattataggcatgagccactgcgcctggctacattggtcatttcatttcttttttttctttaaacctcctatatttatttgatttagttaaggttttattaattacttcctggttttggtttttgttttgcttaattttgttttttctaattctaatgttttaggttgaatatatagctcatttttgggttgtatttatttttaattaaaaccaaagctatttaaagcagtaaatttcactccaaatacaatgctgtattccgtaacttctggtaaaatttgtatagcttctgtattgatttcccactttgatcctgggttattcaggaaaaagttttcttccccttttaaaaaataagatttatttaggtatattccaataccataaaattcacccacttaaagtatgtagctcagtggtttttagtatattaacagagttgtgcagccatcaccacaatctaattttagaaccttttcaacacacccaaaagaaatcctgtcctcattagcagacatttaccattcatgccacctcatactcccagccctaggcaaccactcttctatttctgtctctgtggatttgcctattctggatatttcacatgagtggaatcacaaaatatgtggtcttttgtgaccggcttctttcacttagggtagagttttcaggggtcatccatgttgtagtaagtattagtacttcttttgtattaccaaatgttataatattccattgtgtatatatgcgaaattttgtttatccattcatcaattgacatcaaacatttggattgtttctactttttggctgctatgaataatgctgctgtaaatatttgtatacaagttttggaatggacatgggtttttaaaaatttctcttgcatagatatctatgagtggaatttctgggttatatggtgactttatggttgatattttgagaaactgccaaactgtttttcagaatgagtgcaccattttacaatccaaccagcaatgtatgagagccccaatttattcacagctcaccaacacttgttactgtcttttcttcttatgttagccattttagtggatgtgacatggtctcctaatacatgaaagattttggttttgatttgcattttcctaatgactgatgttgttgaacatcttatgttacgatcagagaatgtaaacctgtcaattcccaacattaaaacatttatcagattttttggtggccaagttatttgaaggaattttgtaaaagttccattactataagagaataaagtatgttttccctcttgttttggtataacatcctttttatgtttttaaaatttaacttgttcatgccttttattttattttactctttatttattttactttctcttttcctcttcatcccattcttacttccattgtcttaagttcctcttttttaagtagatatttttcctttcttaacaagaatgactaaatctacagtgcctctaataattgatcagaataaaattgtacctcaacttggacacagagacaccctctcctccctagttccctcaacgaggaaacagttttacctctggatatttttgagttaattaaaaaactttagtcccaggctattaatatttttcttatagcatgtctcttctgtttcaagaaattttacttaacttttttattctgaattcagggtcatattttcaacatctgttaaacagaaccacatttattttgaacctaccatggaaaaggtatcatatgatataactttgagggcgtgaactttggagccttggtagactgggtttgacttaacaccactaaacctctaattctgtgtgcataaaatgaaataataatgattataacaacacacagatgaaaggattgttgtgtaaattacctgctattacatgcttccttataacaatacttggtaacatgtattaagtgtttacctggggccagttcagcgctaagtaccattgaaacataatctcatctaattttcataaccacttgagataaatatttcaaattcattttgaaaaataaacctgaagcagctttttcatgttctcatagctaaaagttggcagagctagaatttaaacctttattaattttagtccaaatctcatgctcttgctcatattctattttaattgataagcagaatatgtgtttcttggactttatctacttcacagtatccagtgcagtgaactgtactttggttcccccaggagatgtctgtgtagtaagtgctatctgcctctgatcatatggacactgtctttccagagttcttggagtctctgcggagtccctgggccagatctcacagtgaaagctgcaggatcttccttctgaccccagcagtccccgttgagtccaccgatcccactggaattataaagttgtcagcaagaaagccccagggctgaagtccaagtccgtcgggaacatgccagctaacgaggacgctccccagccaggggaacatggcagtgcctgtgaggtgaggaggaggaagaggtgcccagggattggaattcatccacagccctgaaggaaagatactacctcatagttttcatttctagtactttttttagcaggcaggaaaatttccccccaccctcatttttattggtcatttatttcccttttgtgaatttccttctcctgtccattgctgatttatttatcttagcttatggattttaaaagaggcttttgaaaatatttaggttaatagccctttatcattcttgcatatttttatgaatatttgttgtcacttcgtaatttgcaattagctcttagtttcatttacaagtggtaaaggtatcaaatagttctctaagtcttgtttaaagaaaaaaaaaagctcttccatgctttgttttccaccagattccagctgcccagaagcaagcacccttactctttttaatagttttaaagaatgttttgggtgttatctattggctttccactatggaagatagagattgagcttttctttacacccctactcacatacacatttcctaactccacctccctaagacaggtatatcattgttttggtgagattcatggtcagtgttgatcattgaatcccatggtatctatgctgtgatgactatttcggcacaacttttttcttttccctggaattaacaattttctgtctcagtcatttgtttgtgttactatatacacatcaatcatttaactccaaattcttccctggtgttaaatctcctttctatatattcaaacatattaggtattaatcacagtgataataattaaaagcagtcatacaacatttactgcatgccaagcactgttacacgtactctacgtgtgttcacccatcttcacaacaacctcatgaagtaggtgccattattatctttagagacagggtctcactctgttgcccaggttgaagcgcagtggcacgatcatagcttactgcaacctcgaactcctgggctcaagtgatcctcctacctcagcctcccaagtagctgggactacaggtccaagccgccatgcccagtaggtgccattattatccccatgtcatagaggagaaaactggggcataggggaaaaccatttggcccaggtttacacagtaaatagccagtaataggtggggctgctctcacttctgggcatcactgtcttctctttgaagaaatctctcctggagcttgacttgctaaagtctggactggtgtctttctcagtttgatacagagctgttaccttggtgtcttcccttcaccatctcccaggaaatccccttgacttctctcttgggtcagatctgtttcctggagcttgtgtcttcatcttccttggcttaccccttcattttgtggggagcacatccttgcaaatggatgcatgacaggtacattttatgaaactttgcatgtctgaaaatgtcatgcagaaatatatttactgaatacatataactgtataaatttatgtgtagaaatataaatatgaatgccatggaaatatacctatttgatcctgacactaaatttgtctttttggctgagaatagaattctagattagaaataatttttttttttttttagacggagtcttgctctgttgcccaggctggagtgcagtagcacaatctcggctcactgcaagctccacctcctgggttcacaccattctcctgcctc[175 bp omitted]gcccggcctagaaatcatttttatgcccaatttgaaagcctgtttccaaagtcttcctaggccttttctactcacatgtacattttctctgcttttctaaaactctttttatttggttgtcgatgctcctttgtaaaaattatttgctttactgatttccatttctatctcttttgttcctccttctagtagtactttttaaaaactttatcttccaaatcttcttttgtgtctctcattaatgctgttatattttttcttttaagtagctctttttgtcttcagaatattcccgtgctatttttgttttatggatgcagcatcatatcattctaaagacattagtagtagtttttttgacaacttaattttttgaatagtaatatagaaaaaatggctcaaataattaaagacatataaaaagctatacaggttgagtatccctaatccaaaaatccaaaatccaaaatgcttcaaaatccaaaactttttgagcactgacatgacattcaaaggaaatgcccatttggattttggattttcagattagggatgcccaacctaagtataatgcagatattctaaaatctgaaaaaaaagtccaaaatcccaaatacttctaatcccaagcatttcggataagggctactcaagctccatggtctaaattctcttacccatctttctcctgtctgctcagctctctctaatacataaaaccaggttagtttttctctgtatgattagggtttctttatgcagataacagcagctgagaacacattcttattttctcctttttatgtcacagaaggtagccaattaaagaaatttttatcaatttttgttaatttaaaatatttcagtgaaatataatatgaattataagcaatgctgctaggaacattcttcatgtctccatgcacatgtgtataccctctcttaaatatatacaggggggtgaagttaatgggtcatagttatgtcttaaaaacgtttttattgtgaaatgtaacatacatacagaaaagcatacagaacagacatgtatggccgaatgagttatccttccataggcctagaaagagtccatagttagcattccacaatccctctactcccagagctaactactaccctgacttttatgataatcacttcctttaagaagaaaatcacagctgggcgcggtggctcacacctgtaatcccagcacttcaggaggctgaggcgggtggatcacctgaggtcagtcaggagttcgagactagcctgtccaacatggtgaaaccctgtctctactaaaaatacaaaaattagccaggcatggtggtaggtgcctgtaatcccagctacttggaaggctgaggcaggagaatcatttgaacccaggaggcggaggttgcagtgagctaagatcgcgccactgcactccagtctgggtgacaagagcgagactccgtctcaaaaaaaaaaaaaagaagaagaagaagaaaatcgcaatccatagagtgggagaagatataaacaacagaggacttatacccagaatatatcaagaacaacaaaacaacaagaaaaagcagaatacccactagtcagaggccttcttgaacagatatgtaacagatgaagatattcagatggctaatagacacgtgagacagtgctcaatctcattattcatcagggaaatgcaaatttaaaccacaatgtaatacaactaccccttaccaccaccactagaatggctataatttagaacactgacaatgacaagtacaatgacaagtgttaggaggaggagcactgctcatgagaatgtaaattgacacaatctctggggaccttttagccttattcatccgtacatatgtagaccatatgaggaaacagttctaggaaaacacccaccagaaatccttggctgatgtaccaggacacatgtataaatgctcactgtagcattacttgtaacagccagaaactggaaataatgcaaatgaccatcaataatagagtggggccaggtgtgacagctcatacttgtaatcccaacactttgagaagctgaggcaggaagatcattagagaccaggagttcaagaccagcctgggcaacataatgagacccatctcttaaaaaaaaaaaaaaaaaagaaagaaaaattttaaaaatagaatggataaatacattgaacataatattgagtgaaagaaggtagacaccaaagaatttgttgtgtttatttcaatttatatgaagttttaagacaggaaaagcaaaagcatatagtatagaggggtacatttgtaggtgataaaacttgaaagcaaagtgaggaagtgctcaccatctgaggcagaatagtggcttccttgaccaggggcgttgcagggagggagggaaagaggcatgagtaaggcttccggccagggagctggccatgttctatttccagattgtggtggtaattaggttggtatttgcttcaaatgattagttaaggtgaatatttgtttcatatgtttttctgcatgaatattatatttaataataataatcttttgaaaagaaaaaaagtaccctccaattttgaccccagtggcctatatattctttcccaaggcagctacagatagtctgtccatacaaacacgtgcactcattcacaggcacgcgcgcacacacacacacacacacacacacacacacacacacacacacaacccaacacccctatatccatttttaaactgaaatattagcatacaaaatttccagcacttgcttttctcccttaacaataaagcttggtgattattcagtgtcactacatgtaatgagttacctcattcctttacaaggctacgtcttattctattatatgaatatatcaaaatatgctaaccagttttctattaatagacatttaaatggtttctaatcttttgcaattgtacacaacactgcaatgaatatccttatacaaatcttagttaacacaagagagagtatgtttagagagaaatttctccaagtagaattcccaggacagatgatatatacatttttactctttttgttttgttttgtttacacatttttattcttaatggatatggaaaaattgcctgcctcgtgggttgtgtcagttgtatgagtgtctgttttcaccatacccaagcaacacagtgtcttgtcatattcattttttctttttggtcagtctgataggttacaacacagtatctcagtatagatttaatttacatttctcttatggctgaggttgaatatatgtgactgtgtttaaagagccatttatatgatttttttctgagacattttaaaatttccttttcccatttttctattagggtgttgctatttatggaaggatgttacatgtgtcccagttattttccccaacttcccatttgtcttttaaatgaaaatgttagtgttttctctgtgcattgtttatgaatcttttctgttctccaagttttgtatcaactagaaaagccttcctcattgttcctcattgctcagctgtatttgggaaaaaaacccttacattttctgtttaatacttaattgtttttattttttacttttactgctgcaactagctggattctttttgctattgttgtaaagccttagccagagatctgtcttaatttttcttcaagatgcctacacatttgtcccaataccatttattgaataatctatattttccccactaacatgcaatactacattagcatatacaggcataccttggagatattgcgggttcgattccagaccactgcaataaagcgagtatctcagtaaagagagtcatacaaattttgtggcttcccacataaaagttatgtttatagtatgctatagtctattaagtgtacaatagcattatgtctaaaaacagtgtatataccttaatttaaaaatactactacaaaatggtaacaatcacatgagcctttggtgggtcataatctttttgctgatgaaaggtcttgccttgatgctgatggctgttgaccgatcggggtggtggttgctgaacactggggtggctatagcaatttttaaaaataagacaacaatgaagtttgccacatcaatgaacactttccttcctgaaagatttctctgtagtatacaacactgtttgatagcattttacccacagtagaaatcctttcaaaattggagtcaatcgtctcaaaccctgcccctgctttctttcagtttatgtaatattctaaatcacttgctgtcatttccacactgtccacagcatcttcactaggagtagattctgtctcaagaaatcatgttcttggcttatccataagaaaaaactcctcatccgttaaagttttatcatgagatggcagcaattcagtcacatcttcaggcttcacttctagttctctcgctatttccaccatctctgtagctatttcctctagtggcgtcttgaacccctgaaagtcatccatgaggattggaatccagtctttccagacttctgttattgctgatattttaacctcctcccatgaatcatgagtgttcttaatggcttctagaatgatgaaccgtttacaggaggttttcaatttactttgcccagattcatccaaggaatcaccatctgtggcagctatagtcttacaaaacgtatttcttaaataagacttgaaagttgaaattactctttgatctatgggctccagaatcatgttgtgttaacaggcatgaaaacaacatgaatctccttgtatatctccatcagagctctttggtgaccaggtgcattgtcagtgagcagtgatattttgtaaaaaatctttttttctagcaataggtgtcaacagtggtcttaaaatattcagtaaactatgctgtaaacagatgtgctgtcatccaggctttgttgttccataattcttttttttttttttgagatggagtctcgctctgttaccaggctggagtgcagtggtgcgatctcggctcactgcaacctcgcctctgcctcctgggttcaagcgattctcctgcctcagcctcccgagtagctgggactacagacacacgccaccacgcccagctaatttttgtatttttagtagagacagggtttcaccatgttggccaggatggtctcgatctcttaacctcgtgatctgcctgccttggccccccaaagtgctggggttacaggcgtgagccaccgtgcccggccgatttggcataattcttaaggatcttaggatttacagaatggtaaatgagcattggcttcaccttttttgttgttgtttgtttgtttgagacagggtctcattgtgtcagtcaagctggagtgcagtgacgttatcatagctcactgtaaccttgaggtcctgggctcaaacaatcctacctcagcctcctgagtagctgggactacaggcatgtgccaccatgcctggctaatttttaaatttttttttttaagagatggggtcttgctctgttgccaggactgatctcaaactcctggcctcgagcagtcctcccaccttagcctcccaaagtgctgggattactggtgtgagccaccatggctggctggcttcaacttaaagtaaccagctgcattaatccctaacaagagagtcagcctgtcctttgaaggtttgaagccaggcatttacttcaggcatttacttctcttctctagctatgaaagtcctagctggcatgttcttccaatataaggctgtttaatctgcattgaaaatctgttgtttagtgtagccatcttcatcaatgattttagctagatcttctggataacttgctgcatacagcttctatgttagcacttgagcacttgctacttcaccttgtacttttatgttatggagatggcttctttccttaagcctcacgaaccaacctctgctagcttcaaactttgcttcagcagcttcctcacctctctcaagcttcgcagaattgaagagagttcaggtcttgtgcttttgagtaggctttggtttaattaagggaatgttgtggctggtttggtcttctttccagaccactcaaactttctccatatcagcaataaacctgtttcactttcttatctttcatgtgttcactggagtaggacttttaatttcctttaagaatttttcctttgcattcacaacttgtctgactggtgcaagaagcctagctttttagcctagcttggctttcaacaggccttcctcaataagctcaatcatgtctagcttttgatttaaagggagagacatgtgactcttcctttcacttgaacacttagagaccactgagggttattaattggcctaatttcaatattgttgtgtctcagggaatagggaggcccgaggagagggagagacagggaacgggccagtaggtggagcagtcagatcacacacagcatttatcaattcagttcaccatcttctatgcgcatggttcgtggtgccctgagacaacgacaatagtaacatcaaagatcactgatcacagagtaccataacagatataataataggccgggcgcggcggctcacgcctgtaatctcagcactttgggaggc[133 bp omitted]ctgaagcagagaattgcttgaacccgggaggcagaggttgcagtgagccgagatcatgccactgcactccagcatgggcgacacagtgagactctgtctcaaactaaaaaaatatgtaccctaaaacttaaagtataataaaaaaaattctaacaatcaaaaaaataaataaattaattaattaattaaataaaaataaaaaaacccccaaatcttccaccttaaaaaaaagagaagaaacagatataataataatgaaaatgtttacaatattgtgaggattaccaaaatctgacacagagacatgaagtaagcacatgctgttgtacagatggtcccaatagacttgctctatcagggttgccacaaacctgcagtttacgagaaacacaatatctctgaagtgcagtaaagtgcaatgaaaccatgtatgcctatacatacattccaagatataactctgagtatattgggtatatttctggaccttatcctgttccattgagctaatagtcataatctttattattctaattcctctatatttgttatttcttctaatagatggtagggctgtctctgattaccctttttttcaggaatttactgttttcttgattgttttcttttttgtacacaatttataatttacttaccaaatttaaaaataattatattgccattgtaaataaacttgcattaaacttatatctaagatagggccatttgcttctttatgataattcagatttcctactaaagaattgagtatgggctgggtgtggtggcttatgcctgtaataccagcacttagagaagccgaggcaggtggatcacttgaggtcaggagtttgagaccagcctggccaacacagtgaaactctgtgtctactaaaaatacaaaaattagccaggcgtgatggtgcacgcctgtaatcccacctacccaggaggctgaggcacaagaatcacttggatccaggaggtggaggttgcagtgagccgagatcacgccactgcactccagcctgggtgacatagtgagactctgcctcaaaaaaaaaaaaaaaaaaaaaaaaaaagaattgagtatgtttgcttttttcaagtaatctttgcatttcccgttaatgtgttaacattttcttcaaaaatgttttgacatcagtttttgtttctattttctaaatggaaaaaatgcaaatatatatgaatgtatatcattataaattgaaactaaaattacaattattcccacagaagagatagttgaaagaaagtaagtgaaaggaaaagcaaagaatcctatgattctcttactctttttcagaagaatatagatattgatagactttgggagagaaacatgcatagaattctggtcttatgttgggatgagtgataagactaaatgtagaatgaatagtaattttcaaatgagcattaagggggaaaacaccaaaaattttatgtgccaaggaaattaaaggaaaccaaaagaaatatttaaatagcagaaatccatcctagtgttccaataattacatatggcttaaaatcattcattaaaagaaaaacatcgtcagcagataggaaaaaacaactgaaaaattcccaaaggtccagcattattttataaatgtgagttac[133 bp omitted]tctactaaaaatagaaaaattagatggtgctcacctgtaatcccagctactcgggaggctgaagcaggagaattgcttgaacctgggagacagaggttggcagaggttgcagtgagctgaaatcatgccactgcactgcagcctgcgtgatacagcgagactccttctcgaaaaaagaaaaaaattaaaagacccagaaaatatgaaaatgaagggacagaaaatgatagacttggccaaaaaacaccaatagaagcctgtggctgcaattttaaaacctgagcagagggaatataaggtgaaaaactttgcaaggtatgaaagtagatggttcttcaaactgtgaaataccaagaattataacatttatcaacacatatatagctaatgatatatccttaaactatgtaaaatttaaactaggtgaaatagttaattgtaccactagccactttaacccagcctttttcagaaactagatgatgaagcaaagaaaaaaaaattttaaaactttgctgtaatatggatcatcacacagagcatgaaagcatgaaattaaaaataaaaagtaagcagctagtgaaaaataaatattccctatgcacattaaaatattttacataaatatgtttaaagagaaagcataaatcaccttacaaaatacatacaagtaaacatcaagaggcacatttcaaggtttatgcagtaaagctaaacttacaggtggacggaaaattatagatttgaatgtccatttattcctttcctatacccatgaactttccttcctgttagaaatgatctttccactgaaccctttcccctcccttccagttatctcctctctttcctatcacatcacttttccccttctatgctgggccattctcacaagcatgcaacatgcagaaatattttccatctgaaaaaatctgcccttgaccccttatccactcccagccaaggcgtttcaccagaggaataagtaattcctgcaagctcactgacaaaacctgtgacttgcaaaacagtttaatgtcttctcctgttaggtgggttttgggccagggacacatttcctcaaactggggcgaggctgggggttactctcctataatctctgtggtacacttctttgcaggtcttgggaatctcaattatgccaacccctgaccctcaattattccccttttattctgtaagctgccattcttactaccaagggtctcatactttttacctaatgttgtggtataacagcctgccaaagagaacatcagcacttacagatcagcctcactcatgaatagtgatggaactgttataaatgaaatatcatcaagcagaatccatcaattcctttaaaagtcactcattctgaccacgtggtccaatattataaaatctataatccaccatattaacatatcatcagagaaaagcaatgtcacaaaatttcaacatccattcttgattttaaaaagtatcaaagtcaagcatcccacacttccagttccttccccaaactcaccctagggattgtcactgaagtagtgaaggctgattaagaacagccagaactcttcatttgggaatgagtcccttataagtcatcttcctttgtcttgtcttatacttttccagaattcgtctctggctgattaagatggagaccatgcctcctttcttttgggacttccttatacactgatgatgttcagaatcctttattttagattgagtcttttatctttataaagtgtcttcctttgtcttgtttcattcttttgccctggaattctactctggttgatattaagatggaggccttgcttcccttcttttggctttttctgatacacctttgcttatccttttaccatcattctgaatctttgttcatttttctatataatatgtgaaagatgtgttttatattatactttctaattttaatgtttctttttaatatgtttcactatatgctctattttgctttgttt[211 bp omitted]gaggcaggagagaattgcttgaacccaggaggcagaagttgcggtgaggcaagatcgcactattgcactccagcctgggcaacaagagccaaactccgtctcaaaaaaaaaaaaagaaagaaaagaaaggaaaagaaaggtttaaattctttttttggttctttaagtggttacctttataacattaattttataaattataattaatattctaattattataacactattaactgtccaccttgagtagtgacaagatttgtatatgttatttcaataattcttttattagttttccttcagccttgtatttgaaggcttatcagttcaacttgcctgggtcaatttttaagaacaaattatatactgattttcctctcttccatatttctgtcattttttccctattatattttgaagtatttgttgatttccacttcattttgtttactggccataatcctttctttgttcctacctgttttgacaggaactgttaaagacattcatatctgtattgattttttgtttttttaatcacttcaaatggtcatgtcaatgtcttttcaaagttgatgacttcaaatcagaatccaaataaggtccacacatttgttcctatgactctgtcaagaactgtgaacagtctgagatttttaccctacttgtgagctaatgttagcctgcgacagtgtcctggatgctggcaaaagagatatgaaactctgggctagagaaaaggactttattactcatggcagtcgtggtagctagagtcttaacatttgtgccagctccccaagtcctgattcctacagggtgacgtgaagagagccaggtgatgcacagtgggtcgcttaggtatcctgagtcttttatactgagtagtaagcaaacttgtcctttgctctggagggagacacaatatatatttccaaggctgtttgctctgcaaacatcctcgaaaagatggcctggaacaaaaggcagtgtggcataataaaaatatatatatttggttcctggcacagagctctgaaaattcttgtaatttcctgagtggataggggtgccaggaacatctgttgttctaatatttggtctttgaccctagttcttgacacagagctcttaatcccatgcaatttcctgggtgataggagcatcttttgttctaatgagatgacctttttttttttttttgagatggaatctcgctgtattgcccaggctggattgcagtggcgtgatctcggctcactgcaagctccgcctcctgggttcatgccattctcctgcctcagcctcccaagtagctgggactacaggcgcccaccaccatgcccggctaatttttcatatttttttttttagtagagatggggtttcaccgtgttagtcaggatggtctcaatctcctgaccatgagatgattcttgatgggctcctggatagcttcaggagtggggctgatcaccagaaagaccaagctgtgattagaagcttggaactttcagcctcaccctcatcctctggggagggaagaggggctgcagattgagatgatcatcatgcctatgtgatgatgtatccataaaaatccctataaaccaacccctgatttatagccaattggccagaagtacagaggcctggacttgtgattggtgtctgaagtaggacagtcttgtgggactgaaccttaacttgtgggcgtattaaattgtagaacacctgttgaagtctgcaaaagatgtggtttggagagcttcaggattggtgaacatggaggtgctgggtggatggcacgcccggagaagacgtagaagctctgcgccccttcccacataccttgccctatgtatgtggataggggtgctaggaacatctgctgttctaacatttggtctttgacccttgttcttgacacagagctcctaatcccatgcagtttcctgggtgataggagcatcttttgttctaatcaggctgtttatctggctgttcatctgtgtcttttgtaatattctttataataaaccagtaaatgtaaataagtgttttactgagttctatgagctattctagcaattattgaacccgaggaggagtttgtgggaatccccaatttatagccaattagtgggaagtacaggagacctggacttctgattggtgtctgaagtggggacagtcttgtgtggctgggccttaacctgttagtgtctgttccaacactgggtagttagttcagtattaaagtatggaacacctgttagagtctgcaaagaattgctcggtgtggaaaaccccacacatttggtgtcagaagtgttctgtgtgagtggaaggaaaaacagttgtttttttccctttttcaggcaatcagtacctgtcctcacaagatctgcagaaatgtgagagccccgtagagaactgtctcacatctccaccttgtttctacactgtctttgattctgcacatgttcccatgagtacactactccactggttactttaattattctgtcagaggctagggccaaatctgtgcaatttgtctcatgcagcacttaattaagggttgatcagcagtgctccaagcagcagtctggccaatactgggccaataccagcaacaccgggccaatccccagtattttcctcaaccgtaacccttagggttccaggcccaaccagctgaacaaatcccataaaccattaaggtctgtctccctgataaaaccaggtgtttttctccttaactttctggcttgacctttctacttggcttcaggcctaatccaggtaacatgatgtattaatattagcaatcgcataaattctatcttgaccccaaagggcaatttcattatccataacgaccttggacagcaagttgaggctgaccagaatgtttccagggccaaggtagcattattaatcacctcggctaaaatcagggacagatttgctaccaccttttctaactggatgattcctatcatgggaataactgcttgcagggtacacataaataacaagccagtttatccctctaggaagttcctcctagcaacaatgggtagccttgttttggtgaggtctcaagagtcatttgagggttacgtgaaccgctggtagtgattccttacacacttgcaggtctctaatgagccccactcaagatgcaaatcaccatattttgggagggaacaagttaatgtctgacttacacacaaagagtacaatctcggccgggtgcggtggctcatgcctgtaatcccagcactttgg[135 bp omitted]tgaggcaagagaatcacatgaacctgggaggcagaggttgcagtgagccgagatcatgccattgcactccagcccaggcgacaagtgagagactccgtctcaaaaaaaaaaaaaaagaaaaagaaaaaagaaaactacaatctcagggtgaccctgggaagaaagtgttgtttaaaactgagggggctccctaagtaggaaccacagcagtccagggacacagggtgagagtacctccaatgtgatctcacagcccactgatagtctttaattagttaagataaaatccaagcagtgtaagaaattgaatgtattcaggctactgcaaaaggagagtgcctcagatctggagatcagagtgtctgggaggggtggttttgaatcttacttttataggtttgagtggggagagttccagtgtggaggtgggttgttgtttttgcattcaggggaagtcctagtcagctgaacagggaaatgtttatctttgtggctagctagtttcaggaaaacaagcttccaatctcagttaatcattcatgagacacagaacaggacgttagagggtctgtctcaggtgttttggcaggttcaggcaaaaggagagtggtctgtgtttggctttttcacaggtaaacccgggagtcatgagaaagagtggacagcaagccttatctaagccacgtgggggagaggggtcttttgcagacagtgtttccaaaacatgaaacggggagggtggttcttaactgttgctattttcagagttctggtggaattcaacattgtcagaccccttcttgttcaaggcagctataaggttgtccttgaacaactgtctggaaatgaggctactggggataccaggtctacaccattgtcagtctagatttgatctccacatgtaactttgttggctcagatttggcctctgggcacgaagtcagttggcaatgcatttgttgtcaggtctgctggattgtgatatgttgaatcatttgtcgagactggctgcagtgtggcactaagactctgggcaggctgtatccccaattgcaaagtgtaagattatacacaggagaaggattagtaatccctgccatctacctgaaagctaagatcttctacttccaaattctggccaggagaacttgccccataggccgttcatgtgaaccttagagaggcaagtagcctttccctggagtttagtgattgactattctacaaggcctgtggtgttcatccaagtagagcaagaggtgttagctatggtgcagacacctccttgaccagctgggaggaaggcaagagctacatgattgtactaatttgagccagtgagtttcaacttatttgctatgttgtagggcagaggtagtatcatatcatttattacttctgcaagggttttggagagatttggagctactttttctaattgcgtaattccttgagtgggtaaaatgatccttatagtgtgcataaagagaaaatcactgccacccagagggttaccaaacactctagtcagggattgctgttaggggaaagaaagaagataatacccagaaatattcaagacagaatttcagattttcaaaacatgttcatatgaccctcgacactttttgttctgatcattacccagggagaagctgaaagaaaatgatccctttctggggtcaggcatattcatgaccaaactgccttactaaggtttgcggaccaggaggaggcaagggaggtagactctgaagtccttttgagtcagtttttgaggaggcttttccagtgcttaataataccagatgcctgtggacggtagagaatatggaagtctgtcgaataccttgacatcagcccattgtcacatggattttgcaataaaaggtacaccattttcaggctgcgaatagtccagaaaactgaaaatagccacaattatgaggccagagctggctgagcagattgaaacagcaccacttttacctgaggagacgtcaacagtggtgcaacctcagtgaaagctcttagaatgggcttaaggaatgatgccatcaatttgccaggagtgagtggggccacacgtcatgtgatgtgacctttcttatcacaatgggtaatcttttagaaggagtcagaagtttggcatgcagtggtagcttctgcatcagaaacttaagaatcttgtaatttgtgcccagtctgtgacaatggatgcattgccatcaccaatggatgatggatccaggcagcagtgactttagtatgaatagtatggaatcagcagcttgatttcactcagtttcatcagagagcggatccttaccataggcatctatggggtgacccaaaccactcagctagtagctacaatttgtttctacagtccatggttccaaaaagagctgactgatctcagtctgtagtcttccaagtgggagactgaaaagctatgccattggcaatagctcaagagttaagaaatataaaagagaatattgagcagagttacgacagtggccttgcattctgcctgctgagcagagcacccacatccattctcagttctgctgaggttgaacagccacatggcccagtggaaaccatcaggtttcagcttagccagaccattagtggatcaggtccaggcttttaggggaacctttgtgaattgagggccccattaagcccagcagccttgctctagttggcagagtgagaaataaatttacccccaaaggggtagttgtcccattttcatgtaaaaccgagatgccactggggacaggccagttatactcttgaatatactattgggcccttcctaccttgttagtcatcaagtctgaatcagccgaccccaaagtgggaatgtcagtcaagctggagagtcacaaggcctccactggtcaggtgttcagtttcgacaagggcccagtagcaagctaatagctatctttcgtaaggggtgttgctggtgactctgtaaggacaatgaaaaatccaaaacccaaagggctcttctgggtggaggttgcctccctttgttagagatcccattaggcaaaatcaccagttacaaacactagtagctcaacagggtcatttaggctttggggaccctgaaggtaaggagcagagaatgtgccacagcttgctggacagcatcctccactgcctgttgggttgggccccactcaaaggacattggtttgcagtttatccaatataaaggatctagtagaatgtccaagtgaggcacataatgtctcccatacctaaagcatccagaatggtctcttttggggctttcttttaggtgtgatgttcaaagagatggagatttttccttgactgaaagagggacagaacattgtgaatccacccagaggtcccagatgctttacttgatgagcaggcccctgaacttcgtcagaatttaccagccacctctgatggcaaaggtgtgctaataccaccgtcagagccattgagatggaagcttctgacttggcaaccaagaagactgatctctatagtgaaaattttgtacatcagagggtagaggtggtcacactaaagcctaacctactcactggtgttaaatgacagggtactcattgcccctgggagagtactgcaaacctgtgttgaaggcctttgccacatgaatgaaaattgatcttggcccttggtgtcaagacctgagattttaccctacttataagctaataattgggcttgccacagttgcaagtgtgctggcggaagtcaccagattcctgagtcagtgataaaagaccattactcagagaaaaagacgtagccagcatcagcttggctgcatgttggagaaaagattaaaaataaaattcctggcaacccaggaaatcctctccacaaatatagaatagaaagaaaagagttttattattgaatatgcactaaaccacactgcagtgtgcatcacaagaaatctgctaatgaaattgcaaagacagaaggaaatctcacccttgtatgtagccgggcggattcatgttctcaagataaataacttgtctcatgtaagaagaactgatagcaccatttgctgtatattctttcataattcatcctaagtttacctggtaattggagtggccatctgtgctagttaattgcccttatccaaaggcaaaaatcaaacttctatatatgacatgcaggtagttacagactagagccaggcacctaggctagactcccagggtgacagggagatagcacctaggctaaactcccagggtgacagggagataggatccttgatgtttatatatcaaagagatggctcctgagctcttaagaaaaacattcttggtacatgcatgcgtgtgttcatggcagcactattcacaacagcaaaaacaaggaataaacccaaatgcccatcaatgatagactagataaagaaaatgtggtacatatacaccatggaatactatgcagccataaaaagggacaagatcatgtcctttgcagggacatggatggaactggaagccattatcctcagcaaactaacacaggaacagaaaatgaaacaccacatgttttcatttataagtgggagctgaacagtgagaacacatggacacagggaggggaacaacacatactggagcctgtggggggttagggggaggctaagagaatcagaataaatagctaatgcatgctgggcttaatacctaggtgatgggttgataggtgcagcaaaccatcatggcacacatttccctatgtaacaaacctgcacatcctgcacaggtatgctggaacttaaaataaaaacattcttggattgtaatacaggcagaagacttgtttagcttttaaaaattcatacacatatcaaaagagcagaggaaagatttacaaatacaagttttttcaggaaatgctctaagaaaagggaagagggaggaaggtctcttttccttttggtaataaggaaaatttaaatgttttttctccttatgatttccccttcttttataataacactacggttttctaattttctctgtcactcaccatttctacctttctttgggcagttagacatctaaagatccagcaaatccatagtaaaatgcagagcaagcaattatgaaaattaccataggatgaatttaaaatgtcagtgcaacatttgcattgtgggaaaatcctttaagtatgtcttaccagtggtgaatggttaaagcacattcttgattagcaacgtgcagaaattctcatttcctgatatattacttttacagattgctggtgttgtccgtattgcttgttaagatgattgtttaagtattattttgtagttctttaggaagtcttacccaatccaagtctaaggagtagctttccagggacctgatattctaatttttaatttagagttttataacacccaataaatttctcctgagttcctgtcaatcaataagtaacaccacatttataaaacgtagccctgtagtacttgttccatcttctcaaataatatgtccaagatgcagaacacaaagatacccctggctattatcgagtttattattatgaggcattctttgaagggtacagattgaacttccagtgcttaatgtgcttggctctaattgttttaagtcttgaggaaaaccccaatctgtgggtcattgcttgcattagtctaaatcaatagtaacaccaggcatgtcagtccccatgagtaacaggcatccacctgtgtttatctgtcccagtttatctctgggactggagagaatctgcatcctaaattaatccaatgacattaaacctgttttcttcagtctctatctgtgactgccagatttgtttgtctattaagtagatgcttttttttatactattcttctgtctcttctggtatagtcatagtctaatgcctatctatttccttaaagatgaacagccctgtgattctgaactagtgatggtatctgggactattttataaccaattgccttggactgtgcaaatgaacctctgagaccttcgtggtgatttttggttccgtcattaaattactccaaatagttcaattctatactgttttccatttccactcctattgagctccccttgctttaaaatatcttacatgatgtgattcatccagtttgtgattgtattatgtgcttttgtagttgtcccaaagcactatgtttattattcaaagtctcaatctcaaaagagttaggtatatctgtacctgtccctattcctcccaggactgtattctaataagtctccttttgcccttggctgtccccgaacaggcctgttaataaattttatattgggaaggctcaagggatacatgtctagctgtgaagactgacagcagcctcagacagttcaagaaaaaccatctacctataatcctgggggctattaaaataggctcagggcattgccatgttccaaacatagtggcgggggggtgggggggatctctcttatatacatcttgaggagtctgttgaaaggattcccaccagtatggatgtaatttaccatcgatgtctttacaactatcagtagttttattgaaccaaacctctaccatagtaaaggtgagagaataaatcacaaggcttactcctataggtattttgattgtcatatagttaacagattccttttttccctctaaggatccttccagtcaaaccagttaacaaaacatttttgtatcaaatttagggcttgagtatctggatgcatataagttactttagtattatcaaacattactagtgaagatggctctgcctttactctgccaataatttgactgttggacttaaaagtccagatcatgtgtattctgaggatataatacggagttcatcaggaaaaacaggacatggcgtgggcacaggacatggtctgtgtaattgtggagaccattactgggagtacaaaaaaaagcagcataacaaataacagatttgttttctagtaaaatgagattcctaagtaatcaaaataagcctattaagaacaggagagcaaggcagtctctgaggatagtagtaatacattttccagaatacctcttttcagtcgaatctcaataccagtgtaagttactttggaaaacttaagtttcaagtcttttgtcagtgctggcttcacaaggaaagcatggatccaactgtattttttgtttttttttattttgttttgttttgttttgttttccctttttttgagatggagtcttgctctgttgcccaggctgaaatgcagtggtgcgatctcagctcactgcaacctccgcctcctgggttcaagtgattcttgtgcctcagcctcctgagtagctggaattatggatgtgcaccactgcacccggctaatttttgtatttttagtagagacagggttttgtcatgttgtccaggctggtctgaaactcctggactcaagtgattgcctgcctcggcctcccaaagtgctgggattacaagactgagccaccacacctggcccaactgcatttttcttttactttgatagcagagtgggtgatcacagcacttgaaaaggtgagcgacggcctgtcttttcccaggaacactttcatgtagatgaaatctcctggttgaaaaaggtggcagacttcttccagcaggtccatccagatctttatgactttatatcttagggttcctaaggaagagaggaactcttctaaatattgaatatgattataagaagattcaattaagttaggcacaggacatggtctcagacccacatcataggtctgccaaacataagttcaaagggagtgataccatgcttgctagcaggggttgctctaatttttaacaaggctagtggtaaagccattggccattttaattcagaaagtcagtgaatcttggccaatgagtttttttagactttgattcatttgctccacttgtccagaggactgaaaatgattgatagagcatataatagtttataggattctgcaaacatttgcataattcctgaacaacagaaaataaaaggtcttactctgattcaatctgcttttgtatccccaaagtgagaattatgtttattaaggaaaactttaccactgcctgagcaatgacttttgaagagggcaaaacttcagggcattgatacacaccataactagacaaacatctcttaccttctgcgggcattgattctatgaaatccagctgccaccaggttcctggtatgttgattggggaaaacttcctgtgcttaccttgggagtggtctgtgaagacttttgctgacaaatagcacatctctttactatgttttgaataaattcatctttttggtaggcatagtgagagtctgaaacctttaaaatccatcttttatgtagctgattttgttgctgacacaatactaaccaagtaaataaagaccaaggagtaggaattgtattgttagctaattcccatagtacagccccccttccttaatccatttgcccattttcttttggaatgcatatttttgaaaataaatgaaagtttcttgtattagaattggggcttctgagctgggtgtcagccgtgtgttaaccgtagtttttacagccctatcagcagaatcattgcctttagaaattttgtttttctgcactatgtggtctctacagtggattattttatcttactcagcagttgtgaagcctctcataactcggatattaattttccatgagatattttagttcccatgaagtcaagaatccattttttcaaatttcccctattatatgacagacaccaaacacatgtttattgtcagtatatagattcactttaagtcctgaaccaagagttgtagatccctagtagctgctattagcttgtctgcttgtgctgatttaattccaggcaaaacataagcgttcaagatttcctgagcagtcaccacagcataagaaccctgaaggtggcccttctcatcccaggtatatgcccctcagtaaaccttatcaaatatgcattttgaacgggaatatcagaaaaatcaggttgctgcctagtatcttctattactgttgtacactcatgatcatctatttgaccaggatctggtaaaagagtagctggtttttgaagattgcatcttccaagcacaagattaggattgggtaataatgctgattcataattaataagatagtgcaccgataaatgctgggtcttatgcacttgtaagatagttgtcatagcatgaagggtatgcagaagagtcaggtgacccaaggtaagggtttgagccttttcactaagtgtggcagctattgctgctgctcgggggcatccagacattcccaacagcatccagaagaactgggaaatgagctgtcggtctatagcctaaccccgccttgtgagttaaaattctactagcagcacttttattttcatgataaaacaagtggaaaggttttaaaaattttggaatctccaaagctaggggagagaccatagcgaatcttagttattcaaaagcctcttcggattctagggaccaaatcagaacatttggagaattaccatgcagttgctccatccgaggttttctgctctttgcagaagctggaatcccctgctctatagtcccctagcagttcccaaaatggtctcagttgttttattgtagtaggccctttcatctgcaaaattgcagcctttacctgacaatagattccctaaatatttcacttcagtttggcagtattagagtttgtttagtgaggccatatgtcccagccaagcaaggaattgtaacaaagccaaagtatcagttttgcattgttcttcagttttagaggctaccagcaaataatctacatattgaataattacagatccctccagtgagacagatttccctaagttttcctgtgagtggctcgagaaaaagagtaggagagtccggaaacccttgagagaccatttgccataaatattgaacttcatcataagtaaaaccaaactagaatttagactcattagctagaggaacagaaaaaaaatgcagaacacagataaactacacaggaaaaattttcagacaatggcactgaagtcagagtagttgcaggcttaggaactaatggggttaatggagcaacaaatgtatttacttccctaaggtcttgtataaatctatatagtggttgtccgtcttcatcaaatgtacctttcttgactagaagtatgggactattacagggtgagtgcccttttaaaattattcctggtttttctaattattttatacatggttttattccttctgattgagctctcaacaaaggttattgtgttatacatggccatagcttatctttttggtaagctatttttattgattcgatatcttgaattaaaccagtatcattattctgtggggcccattgatttgtttcagtttggggtacttttccagcacggtgtgagattgctaccctctgccatccccttttctttctaaaggcacctagtaaccagatcaggtgccttttcctctaggcatctccacaagcactccatctggagtagagaatatggtagcctttattttgcacagcaaatctgcaaggaagtctctcttcaatagctttacaggaggatcaggagaaagtaagaaagcatgttcgttatcagaggacctatctttatgggaactgtggagggaaagaaacaagtagaaggctgacctgaaatgtcagcagcctgtattaacctgtcaccagacggcaagtgagaaatttgaggcagttgtagaataagtagcaccagtatctaccagaaaaggcaaacataggttagcctgagggaaagttattgacacttgctgttcactagtttccacccctgaaactccctcaatctgccagttttgagccaattgccagttgttccttagtggagggttttctccggggcttttctgatgtctctctgttcctgcaatttctgcatcctctggggtctctataatccctcttccaatgtcctggcttcttactctaatgacagttttctctttgtccttggctccctttgtatattgtccagggtagcgtgattcctttggaaaatagttgtaactgaacagttaacgcagtggagtttgtttgtttgtttgttttgttttgttttgacacagagtcttgctgtgtcacccaggctggagtgcagcggcacaatctcggctcactgcaacctccgcctcctgggtataagtgattctcctgcctcagcctcccgagtagctgggactacaggcatgtgccaccatgcctggctaatttttgtatttttagtatagacagggtttcaccatgttgctcaggctcatctcgaactccttggcctcaagcaatctgcccatctcagcctcccaaagtgctgggattacaggtgtgagccaccatgcctggccttacagtgggttttaattgcttctcttcttcatctttctctaacttgtcccaaaactaagtagctgctgctaagatttgagtaataatccgtccttggctgagacaaaggcagacaggaccagagagtggttttgatctgtccctggatttgcactggtaaattttgagaaagcctcaacaaactgctgagaggagtcaacaaggaacacactcatcttctaggttcactgctgtaatttctgccagctcacttttagcagaaaggggttcaagtatgggcattagcaaccctttttaatgggtccctaaagtccttgttcttccatggccatgggggatggcagatagtagcagtcttttggccactattcctcctattgtgacaggtcatcttccaatccctaacatgcctgttccatcaaataagcacagcctgctggttgcagaattccatgcaggagccagggtacatccccatattcagggttgtaaactggaaacacacagccaagttcttgtgcaaacttctgtggctcttgcctgggcacaggaaaggaagtccttgtgtgagtaatactggctgagttgaaggcatatagattcttaccatttcaggttccccttgtgtaggtctggggtagctttgtgatggcatcagccttattggtgatgcagataggaagggctgctgtcctctcattgagtcaagaaagatgtagaattagatagcacttgggattccttttccatattggtatatatcagcctaacacaccttttttgtttgtcttttccaagtagctactgcaactgctgtccatcttgtcacctgcatatggggacacagtcttgtatctcagttattccctgatgatgttgctttattacctgtgcttccctagctatatggtatgtggataataaaggactgttggaggtgcaatctaggctaagcatgaaatggaatcagggcacacaaacctcacacagggcagataattcattgctggtgaaaacagttgggcttttgtccctctttgcagggaaaccccctaagggaaccacccatctcaaagattatggctttcttcttaccaggaatcaatttgaggccacgggggtgggggtgggtagagataaagaggtcgatgcaaggggaacagagtgaatggggacagcagagcaaggaggagcaggagggtttggtgaaagagaaagtacctttcattctcccatttgctcttctgttttcctcaatccttccaaataatttttagctttcttcttagaatgacattcatcccataaacatgagtaatgcatttgcttgcaatgaggtccttctaagaatcaccacaaataagttaattcacccaaataaaaggaatcatcctcaggtcacactataagactggattctcattacagatggatttcattccaaatgttatgtacagatatgttagccctttaagagaaagccctgcaggctttcccatatttttctaccatcaaagctagtggtgatcctgatggagttataggttctgcattacacatgcttctcaatcataaaatctggaatttggaaaagatgatttgtctggctagtatttgaaaatagcacagagctagaagggagacattttataattcaccttcagctggtctgctcgattcaggaacttccaggccatcccatcctcatcagcagattgctaggggaaaattaaaagtaaaatctggcaacacaggaaatcctgactacaaatgtagggaagaaagaaaacagttttattattgaataagcattaagcccactgatttgcatcacaggcaatctgctaatgagattgcaaaggtagcaggaaatctcacccttttatatagccaagcagatacaatccattacatacgtgttctcatgataaatgataactcatcctcatgtgagatgacttgacagcaccatttgttatacattcttttatagttcatcctgtttacttggtaattggagtggccacatatgctagttaattgcctttatacaaaggcaaaagtcaaacttctgtctctgtgataagcaggtagttacaacttagagcctggtgcctaggctaaactccagggttacagggagctaggagataggattcttgatatctgtattcaaagagatggctcataagctcttaagaaaaacattcctgcattgtaatgctgacaaaaaacttatttagcttttaaaaagatttatgtacatattgaagagaatataaatcttctcaaggaaatgctctagaaaagggaagaagagaaaaggcatctttcccccttggcaacagtgaaaattcaactcttttttaaccttataggctaggggttctccaaatcccaattcccacaggggtggctcagattgtccttgatgagtgcctgcacatgcagtgagtgaggtgcactacaggaaatgaacaagcccagggaacctgctactgaacagccgcctgtaagcaaggctcaaacttgcttgatgcagatataagcctgagacgtgtccaggtcaagagcagtccgggccttgctgtgtagtcatacccagcaagatgtgtaggagcacaagagacccatggaagtgtcttctacctccagtggggtagaaaagaaagcataggcaatgtccaacacagtgtcctaagtgtcattcgcttgtgcagtgtattgttatagtcactatgtttgaaacagccaggacaatgggagaaacaactgaattcagttggtgggaatcccctgtcagcctccagctcctgctactctttttcactggccatatagggctgttgtattgacatcttacatatctcatgatacctgctgcctttctgtccttaattgaagctgtgattgctctttgtcctccagggattctctctctcctttttgttggaccacctgggagaggaagggagatggattggggagtggcttgcatgtctcactaccatgtgtctacatatgggagtccctgaacaggagaatcccttttggactggatgagcattcacagcacaagcatgtaaaacatcatgccagtgatacactcagccatggaagccccaataaccatacactgaattggcccaaagggccctatccacaaggtcactttagtttaccttcctcactaatccctgcctaaaccccatcagttgaatttgggtgcacccccccgcaccttgagatcagataggatggtcccttgggcgactgtatccaaccaagccttagaagtctgagtccctcccttccctgaagttctccagcacactcagaggggcgtgtatggtggcctttggtccctcttggaaacagggaggcctctgtcccctctctaataatttattaaaaacagctgatttcagggtagaaggggacagagggaccaagcatgtagtgagagaacgcggtgccatgccagtaagcaagtcttcccatttactttcagtttcaagcaatgcagcagctgctcaggactcgacctagtgaaactctcatgtttttagtatgcccagaactctgtatcgggcggcaagatcagccttactgacaccatctgtttcgactttggggatgcctcagttctacagccatggccacattggtttctggtcatgcccactggtgaactcaggctttactagcacagtagcaacttcttatttttaagatgtccattttaagctggcacatttgctgctcattttcctgatagcataccttaagttgttgcttagttttaaacataaaaacgaggggagttttccaggacagtgtgagctgacctaaaaaaatcttgaattctttgggtcagtttctcatttcctagcattatagatccaatacggggcagtaagagcccaatgctagtcaatgcctcatctgtgatttcccacaagagttcgtctcaggcagcttaccaagagggctaactataggcctaataacagcagccaggatctactgcaaaaaacctctgagaccttttcctgttgcttctgaagggctctaaggttggcatgatcgactgtaggaggggccgagccgtgaacatcccagctgttgccattcttccttaacaaactttacatcccctcctgcctgtcgtgcaaccagaccagccaaagttctgaccattttcctggtttctgtgcctaccagtcatgaattttcctctttttgtcttgagtgtagatgctcttttctgtaactattgtctgcaaaagggttgggaactgcacctccacccctcccaccaatgattctcaatactggttgttactaagggtagaaggggacagagggaccaggcatggagtgagatggtgcggcgccatgccagtaagcaagtcttcccatttactttcagtttcaagcaatgcagcagctgctcaggactcaacctagtgaacctctcatgttttcagtatgcccagacctctgtatcaggcattcccctcaatgacatcccccgattggggggaacctgagactgaccatcacattggtgaggaagtcctccacctggatgagagtttggaataactaggagactctttaaacctacttcctggcacttagtgtgtaagaatttccccagttcctcctcaatgacaagcaataaagtggaggaccatttattgcacagttgaccatacaatttagtcaacatattcactgctgattcaccttaaatcctcttaattgccccatatattagttttctatcactgctgtaacaaattgccacgaacttggtggcttaaaataacagaagtttgttatcctatagttctgtagttcagaagtccaaaatggttctcactggtctaaattaatcaagatggcaaggctgattccttcctcaaggctctaaggaaaattccatttctttgccctttccagcctctagaggccacccatattccttggcttgtggctgcttcctccatcttcaaagccagcaacagtgagtccagttcttctcacattgggtcactctaaccttctcttcttcctcactcttcttcttttaaggatccttgtggctacattggccccacctagatgatacatgataatttcagtattttaggtctgctgatttaaaaccttaataccgtatgcaaccttaatttccttttgctatgtagtataatatattcacaggttccagggattagacgatggacatccatggcagggagtttgggggattattttttccttccaggggtcgacaaggccctcatctttccttttccagaaagctacatctctgtgagtggccaatcctaatcaccagaacttcaagaactgtgaagagtctgagatattaccctacttgcaagataaaaacccagcacagtatcatggatgctggcaaaaaatacaagactcctcagtaagagataaaggactttataatacttgtggtagccggagtgttagcagttgtgctgcttctctaagcctcagtttccacaaggcaatgcagagggctagatgatacctgcacatacagtgggttccattatatgagagaaagcctaagtttatggactccagatcttttataatgggcaataaatctgcctctcctttgtcctgaagggagaaattacgtttagtataatttctagtataacctgccctttgttctggagggagactctgtcttccagggctgcttgctgtattaacaggcttgaaaagataagttggaaaaaaggcagtcagtgagtctgctttcaagatgtgcagagacctgtggagagccatctcccaacagcctctcaagtcccttttaatctatggcaaatctcccagattctcctctctcttgtttttctccttgctatttatttgttgaagaaactgggccatttgccctgtgctatgtcccacattttggaatttgctaattgtattcttgtggtgttatttaacgtgttcctgtatctttatattaatatgaactgatgaatctagaggcttgatcaattcagatttaatttttttgggcaagaatacttcataggtggtgttgaacacacttgctaattcatccctccaggaggcacataataccaaatatgtctgtgtgttcaggggttctcagcctggtccatacattataaaatttctgcagtctttcactcagtagtttcagcagccattgatgatcagtgctttcttttgagacagggtcttactctgtcatccaggctggagtgcagtgatgcatcacagctcattgcagcctcgacctcccaagctcaggttattctcccacctcagcctcccaagtagctgggactacaggtgtgcactaccatgcctggttaattttttgtattttttgtacagatgggtttttgccatgttgcccaggctggtctcaaatgcctgggctgaagcgatctacccaccttggcctcccaaagtgctggaattacaggcatgagtcactgcacctggcctcgtgatcattgcttttattagcatttctcagctggaattcttctgtaaagaataaatttccaaaatcaattatttgtgtaccctgaaatgaagtacttgtgggtgggataataattttaatataaaactcagtaatacctctttcttgatatataaaacacttcattggcaaactgttacttaaaagaattcatgctatttccatgatcagactccagcatacttacctgaatgtttttctcataatcacctccctaattgtcttacttccattttctgttgcttataacagaatacctgaaactgggtaatttataaagaaaaggaatttatttcttacagttatggaggctgagaagtcctaggtcaagggaccacatctggtgagggccttctcattggtggggactctgcagggtcctgaggtggtgcagggtatcacatggctaggggattgagtgtgctagctcagtctctcttcctcttcttagaaagccacaagttccattcctgtgataaccccttaatctatgaatggactaatccattttggagggtgtggagtcctaattagggaaaaggagttgggctagtgggactgaaggaaacaaaaagataaagcagataagctacaagtctgcctttcttcatggtccaggacacatagccctcctgcacaaataactcgcaatcttcctgctcccaactattaccaggccttcagctgatgttatcagtactgcacaaagccctcttcagcatacatcataaacaccattctataaaatccccagcaagcctttctttccttgcagttagctcctctcttgctggtctgcccattgcacccttgcaacatattttcctactttctctaacaaatctgcctttcttcacctacaactgtcttggtaaattcttcttacccctgtgccaccggccccagatagtcgctgcctacctatgacagaggggacagatattcaaaccataggactgacatataaatagtattctctcttttttacagagctgtttgctctttacttaattcaccatgtattttcctgtttccacactattttccttgtctcttctggaaagtatttcccccacttatcttttcaattaatttttttccccaagagccaatttaaactgcaccaactttatggaacctaaacttacatccccagtagaattgactgttttctatttggggcccacggtgtaccctgaatatatttcaatatatttattttattttattttatttttagagtcagggtctcactctgtcactcaggcttggaatgcagtggtgcatccatagatcactgtaacctcaaactcctgggctcaaacgatcctccctcctcagccttccaggcaactgggactacaggcttatatcaccatgcctggctaatttttaatttttttttagaggtggggtctcactgtgttgcccagcctagtctcaagcttctggcctcaagcgatcctcccaaagtgctgggattataggcatgaatatgtttctaacatgcccttttgttttttgtggtttttgaaattgagtcatatttgaaatatactgaattgcccagatcttaaatgtatagtttgatgagttttgacaagtatatgtgtgtgtatatatatatgtacatatatatacacacccatatacacacatatatgtacatatatatacacatccatgcaaattaaaatatagaaagttccctcttgaccagtcagtattctccccttgaggcaacaaccattgttaaggttttaaatccctgtagattaaaattcttgattgtcctgtctttgtaatggaatcaaaccatctgtgtctgacttcagtgtttggcttctgtttgtaaaatagcataatgcttctgagattcttccaggttgttgtgtctatccgtggatttttccttttttgttgctgagtattccattgtatgaagacaccacaatttgtgtagacattcatgtgttgatgaacatttagaatgtgtctagtttctgattatcatgaatcaagcctgctatgggcattcttatataagttttctgaggatgtatgttttaatttctttttagtaactactaagaaatggaattgctaaattatatggtaggtatatgtttaactttattagaaattgtcaaacaaggtctggcacagtggctcaggcctgtaatcccaatactttgggaggctgaggtgggcggatcacttgaggccaggtgttcaaaaccagcctcgccaacatggcaaaactctgtctctactaaaaatacaaaaattagccgggtgtggtggcacacgcctgtaatcccagctactagggaggctgaggcatgagaatcccttgaatccaggaggcagaggttgcagtgagccaagatcacaccactgcctccagccagggtgacagagcaagactctgtctcaaaaacaaaaacaaaaacaaaaaaagaaattgtcaaacaagtttccaaagtgatggcttggttttacattcctaccagcaatttttgagtttctttttaattttagcttttctagtgagtgtctatgctttctcaatatagcttaaattgcacttcccttacaactaatgatggtgaacatcttttcatgtgctttattggccatttgtatatcttttttgtgtctgctcaagtattttgctcattaaaaaaaattgggctgtgtgtctttttcttactactttctaggagttctttctacattcttaatatgggtgttttgtatatgtattgtaaatattttctcccagtctgtggcttcacttttcattttctcaatagcgtcttttgatgagcagaagttttaattttgataaggtccagtttttgaagattttcttttatggctggggctttttctactatgtcaagaaatccatgcttacgtcaaggttgcaaagataacctcttacatttccttctagggcatttttagtttcagcttttatgtttaggtctataatctagctcaagttaattttttgttaactttttctatgatttgttttctatttctgttctttagtaattcctttcttttacttctgttaggtttatttggtccttcattttctattagctaatggctccttgagggtaaatttgaggacactgatttagacttttgtaatataagtgtttaaagctataaatttccttgtaaatttgtcttttatctgcttttcacaaattttgatacactgtagtaagcagccttctaaaatggctctcagtgatccccactactcagtattcacacccttgtgtaatccacttccctttatgtgtgggctggacctagtgacttgcttctaataaatagaatatggcaaaagtgatgggatgg[133 bp omitted]aaccctgtctctactaaaaatacaaaaattagccaggcgtggtggtgggcacctgtaatcccagctgctcgggagg[142 bp omitted]ttgctggcatactctctctggctcttctcgcttgctctgatgaaggaaggtgccatgttgtgagctgccctcatctattacctcacagtttctgtaggtcaggaatccaggtgtggcttacatgggtcctctcactcagggtctctcacaaggctgcagtccatgttggctggggctgcattcatcttgaagggaaggatccacttccaagcttactcaagtgattgttggtaagattcagtttcttgcaggctgttgtgctgagtgattcagttgttttaacttactaagttttagagtgatttgctatgcatcaaatagataagtaacacagattttggtactgggaatggggcagcctgaaaatgtgggagtgtccttcaaactgagaagttggtggaggctggaaaagattttaaggagaatgttagagaaatcctaaatttcagagagatctatgggtgtacagcttttgtctaatggtgtgaacccagtgagattcacagaaaataaaattttagagcaaactatattagcagaaatactaccactttggactgaaagggatataaacaataaaaaatggaaaaacatgttggccccccaaaattctttggcaggaagcaggttgagcaaactcttttgttgcctttcatgaaaaaggaaggatacctcagatggtggtgccaaggacccagagtgtggaaccaaaagccatgaagaattattcctaggcctcgagacctaatcaaagaactcctaacatttaaccagtcagataatactttactttcttcagcattttaaaagtaccatccaactgtgttttagcctccacttcttctgttgagcagtaagtggtcacttgaatcaccatttctctgtatgtaatatttggggggattttttgtttgtttttggcttttctggctgcttttaaaatcttgtcttctttggttctcaatagtttgactatgatgctcctaggaatggttttatgtgggttattctgtttggaatttgcaaaacttattgaatctataagtgtatgtctttcaccaaatttgaggagtttctgcacattatttttaaaaataccttttctgcccttctctccttctgggtcttaaattgcatgtatgttagatcttttgatttttgtcttactcatctgttttagtttgtttgtcctactgtaacaacattcctgagatttggtatcttataaacaatagaaatttatttctcacaattctggaggctgagaagtccaagataaaggcaccagcagcttaggtgtccagtgagggctgctctctgcttccaagatggcgccttgttgctgtgtcctccagagggggtgaattctgtgtcctcacgtggtggaaagtgtggaaggtcaaaaaggaaggatgtagctagttccctccagcccttttaaaagaacactaacccattcatgagccctcatgacctaaataacttccaaaggtcatacctcttaatactgttacattgggattaaatttcaacatgaattttggagggacaacaaacattgaaaccatagcatcatccctgagactccgtttgtttttattttcaattttgttctctctgcttttcagattggataatttctgttggtctatgtttaagttaattacctctttcttcagttacctctattcttctgtcaagcccatccagtgaactttttagtttcagattgtatttttcagttttttaaaatagtttatatttcttagttggcctatcctatttaatcattcattatgaacatatttgtatgtttttgagcataattataactaactgatttaaagtgcttttctgctaattctagcatctggatcacctcaggtcagtctctgagtgcattttctcttgagcctcttccctttctctccacacctttctgtctctttctctgttgagttgttttggattgtatctttgttgtgaaacatacattagagatgcttgattctgtttaattcctctgactattgttgatttttttgttttgctttgtgtagggagcacttaacttggctagactcaaactaggaaatgttttctctgtggtatgtggtagctcaaattccagttcattcagctggtcaatcagagatctgggcagagttcattcacagaatttaggcacccttctctctttcaatgcctttctggattcccccttgattttccaatggtagtgatgactgcagaactccccttcaattcttcaagtcaataacactggtggttttcttttcttttctctctctctcttttttttttttttttgagacagggtctcactctgtcacccaggctggagtgcagtggcacaatcatagctcactgagccttgacctctcaggtttaatcagtcttcccgcctcagcctcccaagtagccgggaccacaggcatgtaccacttctcttggaattttagttaccccacgtggcactgactgggcctattcacaagctaaagtgccagcctctcttctaagtgtcagctctcctcccatagatgcctgacttgggttgctccttagtatctttagatagtttttaaaatattttttgttcagagtttatagttgttatgtgtatgaaggttggtctgataaaagcaatgcagtcatactgaaacttaatttttgttaatttttgtatatggtgtgaggcgtgggtcaaggtttatgcttttttcctaatactgatatctatctcttccaacacaatttgttgaaaagacttcactttcgcccattgaatcacattggcacttttgtcaaaaaacaattgtccgtacatgtgtgggtctgtttctggactttattctgttctaatgatatatctgtctgtgcatacatcatcccatactgcctgtattactgtagctttacagtaaatcttaacattagggggtataaatccttcatactttttcttgcttttggctattctgggtccttcgcatagccatataaactttaacatttgtcagtttttaccaaaatcttgacaaataagtgattaaacaagtagaaaacaaatcagtgatgcaacaggaaatttcaacaacactcaaccaacttgatttatacattacagaacaatacagccatcaatagccaaatatatattcttttcagggagacatggaccattatcctagatagaccatatgttgaaatcatacagagtatactttctgaccatgacggaattaaattagaaatgagcaataacagggcatcaagagaaagaggccatatttttgaagagtaaatgaaagcaacaggagagggagctatgtgaaatttttaaaaattgggatggaagggatatatgtgcttccttctacaagttatagggcacaaatttctcataaaaatgagcaacaaaataggatcaaggtcaaatccttactaaaaattataatttttaataaatggaagagtaaatgtcatacataataaatagcagaaatttatgattagatttttatattctacacaatattacatatgtgtatatatataaactaagtatttaatgggcataccatatcgtatattatgatgaaaaagtatcaaaaagagcttcctatctgttttctctccatcctccagtgctgatcatgttgccttgaacaagattgtgttgttacaggtatcagtgtcatttgaggatgtgactgtggacttcagtagagaggagtggcagcaactggactctactcaaagacgcctgtaccaggatgtaatgttggagaactacagccacctgctctcagtgggtaaggacaaccatcctgtgaagttgtgaggagcctgttatgggttaaattgtgcccccaaataaaatatgttgaagtcctaataccccagccccccagaatgtgaccttatttggaaatagagtctttacagaagtaatcaagctaaaatgagatcattagggtgggctttaatctaatataattggtgtccttataaaaaggagaaaactggacacagacacatatacacatacgcacgcacacacacacacaaacacacacacagagggaagacaatatgaagatacacagggagaagatggaatgtgactagaatgatacatctgtaagccaagaaacacttgaggccaccagaagctaagagaggcctggaacagttccttccctagcaccttcaaagagagtatggccctgctaacaccttggttttggagttctggcctccagaactgtgagacaataaatttctcttgttttgagccccctagtttgtggtactttgttataacagccctaggaaactaatacagagttttacacttggaaatggggtgtggctgtgataaataccttaaaaatgtgaagtggctttggaattgggtaacgggtagaggctggagctaggggctaggttttgatatgcttgacagaaaaagcctagattgcgttaacgagactattggtagaaacatgaatgttaaaggtacttttagtgagatctcagatagaaataaggaacatattattgcaaactggaagaaaagcgatccttgttataaagtaccggagaacatggctgaattgcgttctgttgggtgaaaagtagaacttgtatgtgatgaacctgaatatttagctgaggagatttccaagcagtgttgaaagcacagcctggtttctctgtgctgcttatgtaaaatgtgagaagaaagagataaattgaagaaagaattgttaggaaaaaggtaccagaacttgaagatgtggaaaattttcagcctatccatatggcaaaaattcagaaagtgtactctggaaagaacaccaagggtgtgtctggacaaccgattactaaagagattaggtgtgtgacttgtggatccaatcaactgtctcactagaaatgcttccaggttggactgaaggggacagagacaggagaaaatgaaggaaggctgttggacttctgggattctataagcaggaaatgtgatgataaagctatttcgactgtgaacatgtgtcatccttcaagaaaagggaagaatgactttgaggatagttcagaagctagtagggctgcagctgccaccacaggccctgaaggcacaggctggggagatggggggacccattgcctccttagtttcagagaacagggccatctgttttcagggctgagggggcagggccaaggttgcagggttatcatgtctgatctgaggttacaccatgtattagttacaccatgtattagtccgtttgttctcacattgctataaagaaatgcctgagactgggtaatttataaagaaaagaggtttaattcgctcacggttctgcaggctgtaaaggaagcatagtggctcctgcttctgaggaagcctcaggaagcttccaatcatggcggaaggcaaaggggaagcaagcatattacatggtgggagcaagagcaagagtgagggggagatgctgcatacctttaaacaaccagatctcacgagaactcactcactttcatgagaacagcaccaaggggatggtgctaaaccattcctgagaaatccgccaccatgatccagtcacctcccaccaggccccatctccaacactggggattacaatttgacatgagatttataggggacaaagatccaaaccatatcaggtgatgaagaccaaatatatatatctttttaactttcccttatggttcttgttgactatcaattttgtgcacgtatttagccttagtagatggagtttactacccactttggggtacattctcaagcaacatggccccaataatgcccaggcccagtgcaccagagcctgctgctggccttataccatcatcaggctgggcctcaatcagaaggacttgggtgctataagcagcagtggggagtgggtcttctctatgccacatttccaacacccccactgtggggcagaggtttagcactgggctcttccatgttcacttgctgttactgagggaatccttgttaagtttcttctccactaactagtgtgcttaaattcagtgggtgagtaaattctggcccaatagcaagccaaaaattatttctcaaaaagagagtagttatccactactacaggatggcaggactttgctcccaaatcctaaagatctgcactgtgattcacctataggggattgccaaaggctccaaacagcatccctgtctgccattgtcacttcaagcaccattggatctgctggatcatatggtccaagcagcagagcagcttgcacagcagcctggatctgttgtagagtcttctcttgttctggtccccactgaaaactagctactttttggataacttgataaatgggccagagtagctttacccaaatcaggaatgtgttacctccaaaatccaaagaggcccagtaagcattgtgccttttctctttttcttataggaggggccagatacaacaatttttgcttcaccttagaagggatatctcgacatgctctataccactggacccctagaaatttccctgaggtgtaaggcccttaaattttttttcagatttatttcccactctctgatatgtaaatatcttacccataagtctagcgtagttgctgcttcttgctcactaggtccaatcagcattatctcattagtgtcatggaccagtgtgatatcttgtggaagggaaaggtgatcaagatgcctgcagactaaataatgacataggtctggagagttgatatacctctgaggtaggacagtacaggtgtatagctggccttcccagccaaaaacaaactgcttctagtggtctttactaacaagtatcacaaaaaaacatttgccagatcaatagctgcatagggtaccagggaatgtgttaatttgctcaagcaatgaaaccacatcttgaagagcaagtgtaattagagtcaccacttggtgacgtttacagtaatctgtcactcttcaaaatccatctattttctgcacaggccaaataggcaaggtgaatggggatgtggtgggaatcaccatccctgcatccctcatatccctgatggtagcactgatttccgcaatccctccaggaatgtggtattgcttttggtttactattttcctaggcagaggcagctctagtggcttcacttggcctttcccaccataagagccctcattccacaggtcagggaactaatatggggattctgccagttgctgaatatgtccttccaattatgtattcaggaactggggaaataaccacaggacaggttcagggacccactggatgcactgtgagatggacctcaactaaaactccattaaccactacactttgtaagctcctacgctgactggtggaccatagtggtgtttgggtctcctggaattagtggcagttcagagccagtgtccagtaattcccaaaatgtctgattattcttttttcccaatacatagttatcttgataaaaggccataggtccctttggggaacactgggagaaagatttcatagtataagtttttgacagtgtaccagggtccttccctaagggaacctggcttccccttcattcaaggggttctgggtctgagtctgtaaataggctcaagtctgggaattgattgaagggctgtgactttgtgcttttatgattcgagttagagttttgttcacttgacctagaattcctctacttatacagatcaacttattattgtgtagactgcctatctgtttcttttctcaggacaccatgatcaactagccagtgccataggtctctgtgaatcagactattctgattgttgctttgactctgctgtccattgtggtagccatgttcaccttgcatttggcgattaagtacctccctttaacccctgccaccccaggatccaactacccccattgcacttaggtttccctactcagtggctgcagttcccactgtaagttccagcctacagacaagagcacttggacatcttcaaggatgctcgggctccccttaaaaatttgtttctcacattggtgacaggtgtgtcctctggaccctcccagagtagatgaacaggtatcacaagataaatcccctccaacagtacaattctttggataccttcctctgcagagtacccaggcagttctggcatttcaacttcatttagtgtaggccaccttttggtccatgtttagccaaccagccaaccaaactgttagagccctttctaacccctccagcagcaatatcaaattcagaatctctgcttagtgggcccataccaatcaattcagcctgatccaactttttgtttcttccacctttatcatacacccttgatatccatatcaatgtatagtctttagatttgtctgcataaattaaatgaatcgtgccgttcttttggtgtacacacatcctcatgggtcattctttgtacttcaccttttgggacctgctttgacttaagtccagttatatgtctaaaagcaaagaagggtggtgagcataggctcttaagggaattggcagtgcctgtcaaggcaagtacctcaggggaagccactgaaagtgcttcaggcaaagtagggttaaccttctcagatagggtagaagggctgcctctactggcaaaggagactcaagaatttaaaggttcaatgtctagtctatttccaattagtttttttttcttttttagtctcagatggttgcttttagggttccctcagtctcttgagagcccctgatgggaggaggggtcccaaagttcaagtgactgtagggagttaagagactgaagtaggaagggaaaggtctggcaggaatggatagaggggtggaagaggtaggagtttgaagagtgacctatgcgaggattcaagagagcttaaagggaagatcaaaggtggtaaaaggaagaaggaggagcagaagcaatgggaagggagaggttttggaggagacagttgggggagatgtaaagtttcccaaggaaacccctgaagttccaaattatccttagtaaaatcatgccaacaagacaggaaacaggtagagttggtggagcatatagccagcaggggttcaaaaatggatattttggtagactgagaagttcccatgttttttaactaatagtacttttatggttataaatagagaaacttgggactctgacccagcttctgttccttacagaacccagcctcttacaaaaagagaaacctaggagactaacccagcctttccttgcatgagactctaacttactttcttataaacagctgcttacctggaactttaacctaccttctagcatgagaatcacttgaacccaggaggcagaagttgcagtgagctgagatggtaccactgcactccagcctgggtgacagagtgagactctgtctcaaaaaaaaaaaagaaaaaatcaaaatctgtccttactgtgcttcagtggactgtcatccagaggctcaggagttggactcatcaatgggtccccaatcagtcaggagtgaagacaaaggcttcgaaggtgcatacttcagattctgagtgagaagtctggggtccagtgatcagtctgatcttatccgagttgtagcaccaaaactgtcaaagaaaaccagagctggacaatagttaaagcagtgaaaatagattttattcagaactattacaataggggaaaagatacttcggtatagaactgggctcaattccaaatacaacgtggacaagtggggatttataaatatagcccaggagcagagtggggccagtcgatggaaaatgactaatgcgaggaaacatcaggggtaaagggggattgttactaaactgacctgacaagattcttgctgaaggcaggtgagggtgatcaaatattacgtgggggatagtacaagatgaggaatttgatcagatatcaagggtgatcagatattgaggctgggagattctagctaaactgacttaacaggaatcttgctaaaattaggcaatgccaggattccccttggtaatcatgatcagttaccccagccaaaaccatagctcccttgtttgccagttgattcaggagcatgagggacccgaagtggtcgggtgggagttttcacttttagtttagtggaatcattgtgtgtctcctggtggaagtatttctccctttggaattaagacctctagaacagcagagcataaggtcacagagacaggtagcaaaaattttgctagtggaccattaggggtaataggggtgtcattcctggcccagggctacctgccacccagtgggctcagaggacagatcatggagacaatgagattattcacaagccttaaaatctaattgaattttccctgctaggtttcagacttgggtcccattatctcttttttcattccagtttctcccttttggaatgggaatatctatcctatacctgtcccaccattgtattttggaagcagataacttgtggtctggtttcataggttcacagatagagaggaatttttccccaggatgaattatatcctctctcatccataacttatttggatgaattagatgatgagatttgagacttttagttgacgatgtcgagatgtgatttttgacttacaagttgatgttagaatgactaaggctttggaggatgttgggatggggtgaatgtattgtgcatgtgagaaggaaatgaattttgggggactagagggcagactcttgtgggtagaattttgtcttcccccaaaactatgtggaaatcctacccctcgatacttcagaatgtgaccatatttggaaatagagtctttgcagaggtaatcaagttaaagtgaggtcattagggtgggccctactctaatctgactgatgtccttataaaaaggggaaatttggacacgggggaatgccatatgaagatgaaggcagaaattggggtattgctgctacaagcatgcgtagagggaagacaataagaagatacgcaggtagaagacagacatgtcactggggtgatgtattcacaagccaaggaatgccaaagagtgccaacaaacactagaaactagaagatgctgaaaggttctctcctagatccatcagagagagcatgaccctgctgacaccttgattttggatttccagcctttagacataagagacaataaatttctgttgttgtaagccaccaggttttggtactgtgttatagcagccttaggacaccaatacagagcctcgttgtgtttcccttcaccaccactgagctatctgggacattagaaccctatgatgatgtcctccttgacttgtctgagattcttcagtcccttttcacctctgtgattattactcagttccccatgaaatgtggttacttctccaaagaacaaatggaaagcaatttgctggacccaattctctatcgtgtcctgttaacagggttcgaagttcctaaaccagaggtcatcttcaagttggagcaaggagaggggccatggacattggaaggggaagccccacatcagagctgttcaggtgagtgggtgtgacccaggcagatggggacacgaagtaattttttttttccctaaggaagaccgatgcctttaaaatgctgttattgcttaaaggttggaaactttataaattgcttgaggataggtagcattggcctctcgggtgccaaattgttctctccttttatttctcttactgttatcacctgtcttctttgcttggctttcttccaggagaattgccccaattcctatactctggattacatgccagtcttcctcactagcggtcttgctttcttggatattctttccttccttcagtcccatttttatgtgtaattccttaaaccacaccccagagtcttagattcttatcacatacatttcagttttactggatttgactttttgaaaatccgttggttgcctcacttctgttcttcctagcactcttgcactttattctttcttttgttctcaccttctcactctaaggtaccaacaaactctcatctacaaccagcctcacctcctgttgcctttgtaagtatcaccttcagattcctcactcctctccaccttcccatggcctagtacctctctcccatcttctgactttatggtcactatcacttagcatttcttcttttaaaatccattttattaaggtagaatttacacaaaatgaaatgtatttattttaagtggacagtttgatgagttttgataaagatatacaccagtgtaaccaccacccctattgtgatatataccattccttcacacagaatgctccctcatgccccttgcagtcagtacacacagccccaggcaaccactgacatgctttttgtcactctagattagatctatctttattagggttttatataaatggaataataccttacatactcttttgggtctggcttcatttgttcagcataatcattttgcaattcatccatgttattaagtatatctctggtttattccttttgaatgacaaatagtatttcatggaatgaatatattactattcattaatctctacacctattgatggataggtggttaatatttggttattatgaatgaagctgcagtgaacattctcgtatgtctttgtgtgaacatacgtttacatttttcttgggtaaatacctaagattggaactgctaggtcatgtaataagtgtatacttacctttgtaagaaattgccaaactgtattccaaattggctgtaccactttacattcccagcagcaatacataaggattcctcttgctctacatcctcgtcaacacttgttatcatcaaactcttttatttttgctattgtagcggatattataatttaaagttgcatttctcttatgagaataatgatgttaagcatctttttatgtgcttattgaccatttgtacattttttggtgtgaaatatctactcagatatctttctcattttttaatcaggttgtttgtcttcttattagtgagttttaatatatttactggatacaactcctttgccagatatatgtattgctaatattttgttccaatctgtggcttgaaatttcattttctttttggtgcccatcaaagagcaaacattttaatttgatgaagtccaatttatcatctgttttattgttagtaccttttgcgatctgtttaagaaatctttgcctaccacaaggcacaaagattttctcatactttcttctataagttttatcattttaactttttcagttaggtctgtgattcatttttcaatactgatatctaattgttccagaaacatttgttgaaggggctttctttttcctattgaatttccttggtatgtttatcaaaatcaattgactttatgtgtatgagcctgtatctggtctctcatttctgttcaattaatctatttgtctgtctgctttaaaagataggttttattattatttaggttcgatgaagccaacagatcaggagacaactgccattggaaagacagtttgttataattcccaagaggcgggggtataccacaccatacagggccatgcataccacacatgtggaagcaccaaggtcagttgggatctagaaggagtgaggggaaagcataggccagagcctttatttaggttttgtgggaaggaatggactaggcaaggtcagaaggctaggcagatttaagattggctagtttggataattccactgggctctagggtatagggactctccccagttgcttggtacctggccctggggtgattagagcagggggatagtggctcaacctgtgagagctcaataaaagaggcagttgtgggtatgggctgtgtattggctgctttgcatatgaaaggcatcctcaaggtcaagttatttcctaatctctagaattagctatcactgggagtgggcagtctctccaggatcagttaagccccagatgccagaacatcaagggtacagaaaataagaaaatatagttaatacgttatccttttagcaaacccatactatctttattactgtagtttttacagtaaatcttcaatcagggagtataagtccttcaactttgctttttaaaaattactttgctcttctaggtcatttgcattttcatatacattttataatcagtttgtactttttacaaaaaagcctactgggattttgtttggagttcagttaactctgtagatcaattttaggagaattgacatcttaacaatattgagccttctaacccatgaaaatggcatatttctgcaattatttagttctttaatttcatttagcagaattgtatagttttcagcatagaggtcataggaaaccttcattaagtttatccctaagtacttgatgcttttgattctgttttacatggcattgttttagttttattttttgattttcattgctaatataaagttttttaaattttatttttagattgtttattgctagtataagttgctagtgattgatttttgtgcattaactttgtatcctgaggcactgctaaatctacctattagttttcttgtaagttcctcaggatttttcatataagtaatcattatcacctaaaaatagggacacttttacatcttcctttccaaactcatgttttaatttcttttcattattttactgtctaagactttcagttcagtgttgaatggaaggggtgagtgtgggcatgtttgtcttggttctgatattgtgggcaaaaacttcagtctttcaccattaagttatgatattagctgtaggttttctgtacctgccctttaacaggctgtgtaagttcctttctaatcctagcttgtttcatagtttttttttttaaatcatgattgagtgttgaattttgtcaaatgctttttctgcatctattggagagatattatatatatcagcattttttgttctgttattatggtgaattcattgatttttaaatgttgaattaaccttgtatttctgagataaatactagttgattatgacgtattagctttattatatattgttggactctacttactgatatttgacttaaaagtttgcgtttttcatgagtgatttggttcatggttttcttttttttcaatgtctttgtcatgttttgatattatggttatactggctactaaaatgagttatgaagtgttcccttctctattttctgaaatactttgtgtgagattattatttcttttaatgtttcatggaattaaccaagaaagccatttggacctagaattttcttgacaggaaggatttaatgacaaacttaatattttaaatagatgtagagctattcagattttttgtttcatcttttgccagacatagtaagttgtacttttcaaggaattttgtctatttcctctatgttgtccaatttaatcctgttgtggtctgagagcatactctttatgatttcagcatatggtctacctaggggaatgttttgtgtgtccctgcaaagaatgtatgttcagttgttgatgggtacagtgttctataatctataactcaggttggttccatgttgttgaaatcttctaatgccttactaatttgtcttctacttgttcattcaattatttgtaatttgggggggttaaaactgtcaaagagatttaaaaatttatatggatatgcaaaagacctagaatgaccaacacagtcttgaggaagaagaaaaagtacggaggattgacactaccaaatgttaagatttactttaaagctatagcaatctggacagtatgttattggtgtaaagacacactaatatataaatggaacagaagggaaagactaaaaatagacccattaatatatagacaactgatttttgacaaaggtgccaatgtaatttgaagggagaaatgaaagtcttttcaaattgtgctggaacaaatggatgtcagtattgggggaaaaattcatactttgacccatacttcacatcctatacaaaaattaactcaagttctagtattatagaattgtttatattgaaataacctgccagacagataaaaaattgttaaccctggaaagcatatttttaaaactagctactgaagatgctggaaagtgatcaaaagaacatttttctgctccatcatattttgagtaatttggattgcgtcctgaacattatcaatgtttatggtaacatggtattctgttatattgttctgaagaatgtcagtgttcttatcacagcaggcaattaactaggttagattgacactggaaatgctgtctcacctaaggcgagtggcaactcaggtgcacttcagccctgctttaattttgctctacccatgcaaagttgaggggtcagccagagacttaggcagattttatacacagaattaggaatttgctttttttgattctttctttttgagttgcccccttaatctctagtggccccgggtacccaggccttcttcccctgattcctctcgcaaaaggattacaagcttttatgagaattttagctgctccacattgctgctaggagtgcagctactctcaacagaaacccgagaaaaggggaactcactacgtgctagtcacttcctctaacttttgacccccctacaaaatctgcctgcttttgtttttttatttttgtttgtttttttatttttgtttgtttttctagagattacatttactatctgtagaagggtctttttcagaagcttacttctccatactggaagtagaactcttaccattgattcttgtacattgaccttgtattccgagactttgctacattttgcttattaattctagtgggtctttttgtgaataaataccataaaactttctgcaaacattatcatgcctttctgtcatttcctttttggtctatatgctgtttatttttattttatcttgttcccaatctgaaggcaaaaactttcagtctttcaccattaggtgtattagctgtgatttttcttagatgctctttattaatttgtggcaatttctttctattcctagtttgatgagagtcttaaacatgaattgatgttgaattttctaaatgccaaatgctttttatgtatttattgaaaagtgcattttatcctactaatatggtgaatttttactgatttttagatgtcaaactaaacttacattcctgagataaaccttacttcatcatggtgtattatctttttatgtatttcttgatttgattcgctaatatttggtaaggatcttaatctccatgtctttgagagagattggtctttagttttgtgggcgggggggggttcccttataatatctttgattttggtatcatgttaattctagcttcataaaattagtttggaaatttcatgcctgctctgttttctgaaagagtttgtgtaaacttgctatatttgctagaatttttcagtgttcacgtctcttgtgattttgtataagattactttaaatttctttttcttaaatatgtgataaaattcaccagtgaactcatctgggtcatctgaagttttctttgtgggactgtctttaatttcaaattcagtttctttaatataggaatattcagattttttatttcttcttgttttaataatttgttccttcaaggagttcgtgtattccatctaagatgtcaatatttcgacataagtttttttcattaatacttctgtattgtcactttaatgtcttgtatcttcgccaatgtactctctttctctgaagttgataaaatttcaattcaacaggaatatatatatataaacctaattttctatgtacttaataacatagcctcaaaatatatagtaaacactggcagtattaaaaggagaagtagacaaaatgcacaatcatagttggagattttaacacacctatttctctaactgttgtaacaagcacacaaaagaatccctaaagaggtagaagactagaacatgataaaccaatatgatgtaatcgacatacataggttactacatccaacaactacagaatacacattcttttcaagtatacatggcacattcaccagaatagactattttgggatataaagctgtttgcatcaaatttcaaaggattgaagtcatagactgtatgttctctaaccactgttaaattaaaactctgaatagaaaaacaattaaaaaatatctaaatgtttgaaaagtaagcaacacacatccaaatatcccataagtcaaaaaagatatcacaatgaaaatgtattgagtgaagtgatagtgaaaa[133 bp omitted]ctactaaaaatataaaaattaacgcaaatcaataaatttaatccagcatataaacagaaccaaagacaaaaaccacatgattatctcaatagatgcagaaaagtcctttgacaaaattcaacaacccttaaggctaagaactctcaataaattacgtattgatgggacgtatctcaaaataataagagctatctatgacaaacccacagccaatatcatactgaatgggcaaaaactggaagcattccctttgaaaactggcacaagacagggatgccctctctcaccactcctatccaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaagatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaagattccatgctcatgggtgggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataatgccgcatatctacaactatctgatctttgacaaacctgagaaaaacaagcaatggggaaaggattccctatttaataaatggtgctgggaaaactggctagccatatgttgaaagctgaaactggatcccttccttacaccttatacaaaaattaattcaagatggattaaagacttaaatgttagacctaaaaccataaaatccctagaagaaaacttaggcaataccattcaggacataggcacgggcaaggacttcatgtctaaaacaccaaaagcaatggcaacaacaaaagccaaaattgacaaatgggatctaattaaactaaagagcttctgcacagcaaaagaaactaccatgagtgaacaggcaacctacaaaatgggagaaaatttttgcaacctactcatctgacaaagggctaatatccagaatctacaatgaactcaaacaaatttacaggaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatatggagaaataggaacatttttacactgttggtgggactgtaaactagttcaaccattgtggaagtcagtgcggtgattcctcagggatctagaactagaaataccatttgacccagccatcccattactgggtatatacccaaaggattataaatcatgctgctatgaagacacatgcacacatatgtttattgcagcactattcacaatagcaaagacttggaaccaacccaaatgtccaacaacgatagactggattaagaaaatgtggcacatatacaccatggaatactatgcagccataaaaaatgatgagttcatgtcctttgtaggaacatggatgaagctggaaaccatcattctcagtaaactatcgcaaggacaaaaaaccaaacaccacatgttctcactcataggtgggagttgaacaatgagaacacatggacacaggaaggggaacatcacacaccagggactgttgtggggtggggggaggagggagggatagcattagccgatatacctaatgctaaatgacgagttaatgggtgtagcacaccaacatggcacatgtatacctatgtaacaaacctgcatgttgtgcacatgtaccctaaaacttaaagtataataataataaaattttaaaaaaatcaactccaaaaaaaaaaatacaaaaattagctggatgtggtggcgggtgcctgtaatcccagctgctcgagaggctgagacaggagaatcacttgaacccaggaggcagaggttgcagtgagccaagatggcaccactgcactccaggctgggcaatggagtgagactccatctaaaaaaaaaaaaaaaaaaaaaaaagaacttgtgagatgaaactgaagcactatgatgaaagtttcttattttatatatatctaccagaaaattaaaaagattaaaaattggcctatcttgattttataatctgatgttttcaaaaactatttttcaccatggccactgcttctcaaactggggaaccctagccatcttccaggagtgtcatttttttttttcagacatagaagtttaaaaattttttaatcttaaaaagtcctgttgtatatattcacaggtaaaataagaataattttaaagataaaacatatgacttcaaagaaattacaagttgacatcttggactctacccctcgtactttatctcctatgaggagaatttcagtaattacagctgcgaagcaatgacctaggagatcctgatttctcaaagcgtagccagatctttactgacagtgaatgtaaatacaattcaaagtcttggtgcattctcctgagttccatcttcagatataatgtaattctctgattaaatatatatagtcctgtctatactgatcaggaattaagtcaacaaaagaactctggactgattttgatttttcactgtttataattagaggaatgctacagttaaagattactgctttacaactaaaaatatacaacatatatcatcaaagggagtggaactcatgaagccaaaagattaaaacttgacccagtgaaaataatagggagagtaactgtgggtgattttatccttcttccaaatttacattaaaatatattatccctattctttactgcccttttggttgaagaggtaaatacatgcatttttctgaataattaattataacacctcctctagaatcccaaatccactagggattctttcttgaccccaaagagatgctttcagtatgtcatgagtataaactcaagctgcttgccaattataactacttgtcaaatagaaagtcagtagccactttctgtataaataacatttataaaaaacaaaatgaagttgcaaatgaaattatgtcaaatttacagtttctttttttaaacaaagggtcaatgtcatcaacattatctgtaaatcaagttatcatcagatacatttaataattaatgcctgtaatcccagcactttgggaggctgaggcaggtgaatcacctgaggtcaggagttcaagaccagcctggccaacatagtgaaaccccgtctctactaaaaacacaaaaattagccaggcatggtggctggcgcctgtaattccagctactcagaaggctgaggcagggagaattgcttgaacccaggagtggaggttgcagtgagctgagatcatgccactgcactccagcctaggcgacagagcgagactccacctcaaaaaataaaataaaatcaagataacctcttgaatgcaatagctcatagcactttaatttggcaagccatttttcctgttttattataaatctatattagatgtttgaatatggtttgaaatatttcactactgtgctgaaaaagattggttgatagcagcttggagtgctaactggaagatcaaaatcatgtctcttgctgataacctaagagcattaagctctgagtccagtgaggtcatagcagtgtatgctccttgcccttacggagtgtctgtttttagaaatttagattttaaaaggcgtgggacatacgaccaggccctatagccacataaatataaatttcatagaaaaagaataaaagcggagatatattttttgacacagaggcacccaaagaaatacaaacattgcctagctgctgccatttctgtaactgcccagaagggtgacagatttctgaaggggaaaggattcagatatgaccttttctttagtcccaaccactagttttaacaaatgtgaattattgaaatgtgaagggacaaaaagaatcatacatttaaactgtcttgttcagcataccaatattgtatgttacaaatcatcatttctaaatctggattgattctgttgtgtttttgactgtttctaaagtaagtgtgtataaaagttgtctcctttttaaaaagatcatatttttaaataaagcattttttgtagaaaaaaaaaattggccatataagtttgcacctcaggacatacaaaagtgaaaactaccaaagccaaaatttgcttctttgaaagattaacacaattgataaatttagcaagctcaatcaaggaggagaaagaaaacacagattatcaatgccataaatgagaaaagaaacatcattacaaatcttacaggccttaaaaggatactaagaaaatattatgaccaactttatcccccaacatttgataaccaaaatgaaatgaacagtcttagaaaaacagaaattaccagaaatgtcacaagaaaaaaaggtcaaaatcttagtagtatttctatctattaaagaaattgaacttataatttaaaacctatccacaaacaaagctctcaacccacatggcttcattggtgaactctggtcttttagagaagaaataataccaatattattcatgttcttttgaaggaaataaagagagaatacttcatatctcatatgatagtaaattgaactatattagaataaagaattactcttctttgaaagacatcattaagaaagttaatagggaagccacaagctgggagaagatatttgcaatacatatatttgacaaatgactttatattcagaatatataaagaactctcacaaatcaatagagaaaaaaatagataaaagacacaggcacttgaaaaaagaggtattcaaatgggcattatatatatgagaaggtgctaaagatcattactcatcagagaaatgtaaattaaaaccacaatgtggcagccctacacacatacatacatacaaaaaaaagggctaaaatttaagactgacaattatcaaatgttgatgagtatttagagcaactggaattcacattcattgatggtaggagtgtaaattctttcaaccactttggaagataggcattacctactaacactaaatgtacaccaattctgtggcccagtagtgccactcctaggcatatatttaagagaaacaagcaaatatattcactaaaagaaatgtacaagaatgctcataccagctttagcgtaattgctcaaaatttgaaaccactcaaatgtccatcagtgggagaatagatgagcattatgctatattcttgcaatgtgatactacacaacaatgaaaagaatgaactgctgttacaagaacttgggcgaacctcaaaaaatttgttgaacaaaagaagccagacatgcaaatgggtatatgctatatgattcaatttacataaagttcaagcaaggacaagcaaaactaatctatgattgtgataatattgataagtgattggcaatctatggtcagaatggtggttaccgctgagagtcaattattgacaggaaagggccaccagagaactttctgggataattaaaatgttttctactttcatctgagttgtggttacatgggtgtatacatatgagtattggagttcagctttatagctaagatctatactatatagctttgcatacattcattgagctttacagttaatatctacactttactatatataaattatacctcaataaaaaataattagcctgtgagattattcctcaggtatgtttatatagaattggtattggttgatcactggatcatatgtgcaatccacaagtgtgcctattttaccacatttatgccaacactcagcatcgttcagatttcttatcttgtggccaatataatggatgtaaagtggtattgtgttatcttcccccctttctagtatctgctgtccatttaggtttcccctttgttaattgcttgttcctattttgtctcatgtacttttcatagaggcttttttcccactaagatgcactagctaggggtaccatttctgtcttcaggatatctgttctaatagtaattaacttaaaggggtcttccatttggaacacttaaggttttttgtttgtttgtttgtttgttttttaggttgtcatacatggcttttattgttttgacgtatgttccttctatacctagtttattgaggcttttttttctttttctttttttttaattattatactttaagttttagggtacatgtgcacaatatgcaggttagttacatatgtatacatgtgccatgctggtgtgctgcacccattaacttgtcatttagcattaggtatatctcctaatgccatccctcccccctcccccaaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcctttcttatggctgcatagtattccatggtgtatatgtgccacattttcttaatccagtctatcgttgttggacatttgggttggttccaagtctttgctattgtgaatagtgccgcaatgaacatacatgtgcatgtgtctttatagcagcatgatttatagtcctttgggtatacacccagtaatgggatggctgggtcaaatggtatttctagttctagatccctgaggaatcgccacactgacttccacaatggttgaactagtttcaacaaaagccaaaattgacaaatgggatctaattaaactaaagagcttctgcacagcaaaagaaactaccatgagtgaacaggcaacctacaaaatgggagaaaattttcgcaacctgctcatctgacaaagggctaatatcaagaatctacaatgaactcaaacaaatttacaagaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataacatctcacaccagttagaatggcaatcattgaaaagtcaggaaacaacaggtgctggagaagatgtggagaaataggaacacttttacactgttggtggaacacttaaggtttttatttgtattctgatgacttccatgttgacaccactaggtgctgtattataatagtgctctagtacttacttacctgcataccacacaattcccattgaatattctactttattcatcctcaatatgggaggaattgggatcatcattacccaaatcaggaatcctcacattccaaattttgtcagattctgctgtttcttgtttcttccctcttagctgtcttttcttactactgcaattcctattttttcttttttaaagaatgctacttagtctctcatctagttccagtaacatcactccaaaacaggtctgtattttcttatgcttggattattctgttcctaatggaagctgcagattccattcttgtttctagttaatctttgaaatgctactgatagatttcattacctaagacattgcatttatctttgccattagcttcatgaagtagtcttacagttactccatattatataacacatgaccaataacttttctctcagtgccatctataagattaccattattcccagtttaaaattttatctgtacggtttccttaatttatgcttacttcaaattgtttgcctggtctttaatgcctgtcatatatgaagtgtgtctgtgtatctgggctttttattattttgtgctctgccgtccaggtaatagacattttccttttgtgttcaggctttcatctattccatgaaatggcccttacctactccagatttattactccattatttattattcttccctatttctgtttccccatgtcccagatgcttttgcccccagtaatttttgaaagtctctgaaagtaagagctcgtatcttattttcatcattcaaatgttgagcatgaagaaaatacttaccaatattaactaattgaatttgtgggggataagaatagaattttgctgtgttttagagggattttaaaaaattatactgagaggaattcaacgaagattgttattggaaagtaaacacaatggcaccaaatatttaaaagtttaccctcttacacattgtgtttctgttataattaggagtctattacagggattagcaaaatgaatagcatagagagtgcctgcttttgacattcagaagaaaaaaacttactagcaatataattagattagttttctaagtaaaaattcttaatctgcttgatgaagcacacataccttttttaatggcataaaagaaaatgctaagcaggcttaatggggaaagaggacatgaatatgtcctttgatttgaaaataaactggactcttttgaggcatctttgtgtgtgacaagtagaatgtaagctcacgtgagcagctcttttttctagagtgatgactcttcatttacgtactcttcatagaatcgggggctcaggagaggtataaagaagctttttattgcaggagcaaattttttatgatgaacattggtactagtgacataaaaaataattgtctggtacagcaagggatttataatttaaataaagtaaaaagtagaactgcttctgaagccatgcctaggaatccagtgcttagtatctccagaataaattaaagccagatgtgtgagaatacaaatgcaacctaagaataggaggatgagattttggatgggacatgtgtctgaagtacagtatcaaaccgactaaaaggggataagtggatttgatgactcagagcattctcagtatctaaaaatctcttattgaaaaagtcagtggtataatttattcatgttaaaattatttatcagtaatctagtatgtctcatgcactgtactaggaatggaaacatctgtaattctcactctgggcaagaataatgtatgaattatactaatgctaatttgtagcaatagattgtcaaatatagtgactaaaatagtaaggaattgtatttccctcttataggaaacctcattgctcatgattgttcaggaatccaagctccttccaacacacattactccaccatctcttaggatttttgtgggatctgcgtgcttgactctgtgtttctgccaagttcaggttttagtaagcaagaaggtagaagcgggtgtggagaaaacatgcctgtggtctcagtgctcccatctgaaagtggcaccatcattttctctcaaattctcttgatgagaacattgtcacatggccacactaatttcaaaggaggctaagaaatgctctatgactgggcatccatatgcctggatgctactctgttaaatgcaaaagaatggggaaacagattctagtgggtagctttcagtctctaccagagatgacttgtcttttctgctatttttttgttagatatatatatatataatgtaggtccaagaaaacaattacatctggatgtagagttggagtatagacatctatttattgtttgtataggttaggatggctatgactacaatatttttatagacatgaataaattatttttatcacataaattttggatgtttgctgataagcaagattagtgaggatttagaattgaaaatgagtataaatagcagagcatttgttataacagaaaaaaaaagttctgcaatcccagctactcaggaagctgaggcaggaggatggcttgaggctaggggtttgagaccagcctgggcaacatagtgagaccccttgtctaaaaacaaattatgtaaaaattagctggcttggtggggtatggtccccaacacttgggaggctgaggcaggaggatcatttgagcccaagagtacaaggctgccatgagctatgattgtaccactgcactccagcagcctgggtaacagagtgagactctatttcaaaaagaataaagaaaagaaaaatatggagaattttgtcatcaaggtgaagtaaaattcattcatttattgtattttgatcatattcattcttcactatgtattgagccagctccatgaaagacagtaataggaccacttaaatttgtagttatcaccccctctattaaattcaataaacattttttgttatcttttacaagcagtgcttgttaggagaacagtgtggtgtcaacaaagtaagacatgcacctttagtccctatgaagaaaacctttaagcacatagcaaaggacctacctatattagaagccccacagaattaaagaattgaaacccatcgagaagagttgttgcagagagcaagattcaaagtgtgaacactcatccttgtcaatcagggttctcactcttaaacacaatgtcagaagtaagctgatggttatatttaatatttaggcaagaagatacatgtgtatgcatttttggacttgtacacataccaggattcaatataagtatcatctattagtggaaaaaaaaagaattgaaagctaatgaggacttaaactccaagcctaggccctcctagatctttcccctgaaaactcttttattatcaatcttctgtccaccctacctaatagccaagcttcctaccaaaataggactagactgcttatgttgaatgccagcctccaacacttaataaccatgttttatggcaaattatgtaactgtcatgagcttcacttttcttatctacaaaaggtggatagtaataatagatacctcataggacctctgaaaggattaaatgaattcatatgtacagtcatgtaccacataatgatattgagtgacttcagattgtaatgaaattgaaaaatggctatcacctacatacatcatggctattgctgcgttgtagtgcaatgcattaccttttctatgtttagatatgtttaaatacacaaatagttactactgtattatagttgcctaccgtattcagtacagtcacatgctatatgggtttgtagcataggtgcaatattctataccatatagcctagatgtgtagtaggttataccatctgggtttttataagtactgtatactctatgatgtttgcacaacaacgaaattgcctaatgacagctttctcagactgtacccctgttgtcaagcaatgtttgactgcatatatttcttagaatggtgcctggaatattgtaagtgtcgtgtaagagtttggcacataaaagtgctatatatgtatttcctgtcatcattgtcatcatgagatttactgatttccatgtgttcaatttgtattagcttatgtgtaccttttaatctcttgcggtctattgtttgtgtcaattttactttttctttctctttttagatgggaaatttggaattaagccttcccagaggagaatttctgggaaatctacatttcatagtgaaatggagggtgaagacacaagagatgattcattatactctattttagaagaattgtggcaagatgctgaacagataaagagatgtcaggaaaaacacaacaaacttctgagtcgcactactttcctcaataagaaaatattgaatacagagtgggattatgaatataaagactttggaaaatttgttcatccaagcccaaatctcattctttcacagaaaagaccccataaacgtgattcatttgggaagagttttaagcataatttagacttacatattcataataaaagcaatgcagcaaagaacctggataaaactattgggcatggtcaagtttttacccagaactcttcttatagtcaccacgaaaatacacatacaggagtgaagttctgtgaacgtaatcaatgtggaaaagtcctcagcctcaaacactcactcagtcaaaatgtgaaatttcccattggagagaaagcaaacacatgtactgaatttgggaagatcttcacccagaggtcacatttctttgctcctcaaaaaattcatactgtggaaaaacctcatgagcttagcaaatgtgtaaatgtttttacacagaagccactactcagtatatatctgagagttcatagagatgaaaaactctacatatgtactaaatgtgggaaggccttcatccagaattcagaattaattatgcatgagaaaactcatactagagagaaaccctataaatgcaatgaatgtgggaaatcatttttccaggtgtcatctctactcaggcatcagacaactcatactggagaaaaactctttgaatgcagtgaatgtggtaaaggcttctccctgaactcagccctcaatatacatcagaaaattcacactggagagagacatcacaaatgcagtgagtgtgggaaagcctttacccaaaaatcaacactcaggatgcatcagagaattcatacaggagagaggtcctatatctgtactcaatgtgggcaggccttcatccagaaggcacacttgattgcacatcaaagaattcatactggagagaagccttatgaatgcagtgactgtgggaaatctttcccttctaagtcacaactccagatgcataagagaattcatacaggagagaaaccctatatatgcactgaatgtgggaaggctttcaccaacaggtcaaatctcaatactcaccagaagtctcatactggagaaaagtcttatatatgtgctgaatgtgggaaggccttcaccgacaggtcaaatttcaataaacaccagaccattcacactggagagaaaccctatgtttgtgctgattgtgggagggccttcatccagaagtcagagttgattacacatcagagaattcatactacagagaagccttataaatgtcctgactgtgagaaatccttctccaagaaaccacatctcaaagtacatcaacgaattcacacaggggagaaaccatatatatgtgcagaatgtgggaaagccttcactgataggtcaaatttcaataaacatcagacaattcatactggagataaaccgtataaatgcagcgactgtggaaaggggttcacccagaaatcagttctcagtatgcatcgcaatattcatacatgaaagtaatcctgtttcttgaaaatgagagccttataaggctgacaaaagtcaggtctaactatatattataaaattcatccaagacagatcctatatgaatacattgtataaggaaaagcatcaggctatctcacttgagatggaaaaaaattattcagaagaaactctcttaaaaatgcattgaaggagagagaatttgcacagcctcatgaaatatagtaaaagtcatactgggaaaaatgttgtcagtttggtgtgttaggaaaagccttcctatagaaagtattataagttaaattgttaccaaattctttataggaaggagagtgcaaaattatgtaaatgatggtcaggtttactgtgttatattaagcaatttaaagtgataacaaaatgaaaggtagtgcagcaaaataatataactggtgagtagacctactttcagttccatagggtgtttgtggcagaacacagtgcagaacaggaggaatattacattttttttcaaatttagaataattatgtccatcaaatgtttcttactgaatatgtctatcaaatatgtttcttattgaatatttctatcaagtgaatccacaatttaaaagtcactttggttttatatatacacacatctgcagatataattttataagaacacacaaatataatcctgtcattcgtactggtttccatgacatagtatcttgttttctttcattgtggtacaatgcaaagtagccacagattcctcccatcccaagtagcgtctctttgtctactacttgactttgaacttggccacgtgactttctttggccaatggaaattagcaaagagaatcaataagaagcttgagaagtgtgcaaagcctgccttgaagcttaccctctcttgctgctctttgcaaacctgaagaatctcaaattgccctactcgggggtgaggagccaccacatggagcagtggtgagccagccttgctgaggccccttagaccaagtagcctgccaattgtcagaattgggagtgaggttttccaagacctctagccccagctgagccagcctagcccagaagagccataccagttattccagctgatttacagaattgtgagataaataaaatgatgatagttttaagcaacatgagttttggggttagtttgttgtacagaaaatgctaagtaatatttgaaagtatatgtttgggggagggggcatagtggaccaaaacgtgacaagtggcattggctttgggtctgagtggcacgtagaaactggaaaaacagtgaggaaaactgtttttcctcaaataacaaaggttggatagttggcaacccatgttatttagtagggaaagatacagaaaaacagtcatcaccatactctgtgggaagatagagaatggaccaaacgaactggtggatctggctaaggagatttgcagcagaatatgggaagtatcagtttgcttcttttagctgcatatgatacgatacagaaagagagaaatgaactaaagaaataactgtttctttggcaagcagaattcagaagaaatatggaaaagccaaggattgctgggttgaaaaataatgctttcacatcactagtctctccagctatctaactattcgcaaggtaaaaaatggcctcagggtaaagatcaaatcatggttgtgtctgtaagactctttattacagtgtgtgaaatagttcagttggtgcttaggagaccatctcagctaaacttaagggcttctaaaaatcttcatgacgttgtcccatagaagcctgacatactactcaaagtggagagagacctatcttaaaaagaattgctgatgtggcatttggggaaaggagtagatccaaaccagattcataggaaactcacaaagtttttaatagagttttactagtaaaactacctccaggttggacttccagggactgaaacagttcaaaatgaaaagtggcctctggattcccctccctaacttctatgaataggatacaagctgagaaagttactcagatgcaaacacggtccatttcttatggaaaatgaagggcatctcagagggaagacccaagaacaatatattaaaatgagctggggagccgttcccagggagaactgtgccctaatcaagaaacgtatctgcccctggagccaagggaaccgacaacatttgctctgtgggatttcagaatcgttatggaacagtgactgatatgtgcctcatggtcctcctctttttgaatgggagtgtctattacagttatcctgtacctatcccaccattgtatatattgggtgtatgttggggggcatgtaacttgtcatttagctcacaggtatctggatcaagaaactgaaaaactgtacccaaggaacctcagccacacctgaacctgatacagaagacttgagattctggattggagcttgatgccacaattttggatgagaaatttggaggtcctggaataggggtgaacacattttgcatggggtggtaatgtgaatactttgtgaccagaagacacactgtgttaggtagaaaaatgctacagatgtcttcatccctgtatatgtgtccttcttcagtctttatttctctttgtgtttcagttaggataatttctattgatctgtcttcaaattcactgatgttttttctctcaccctggctttgtcaagtctactgctgaacccattgaaggcattcttcaactcagttatgttttatttttatttgtaatatttccatttgattcttacaattttcatatatctgctgaaattccccatcttttcatgcatgttcatgttttcccctttaccctttgtcttagtcagtttgagctgctataataaagcaccatagacttggtggcttataaacaacagaaatttattcctcacagttctggagcctggaagtctgagatcagaatctagcaaggttaggtcttggtgacggccctcttcaaggttgcaaactgctcacttcttgcattttcccatgtctacagctagagaactctttgggatcccttttataagggcaccaatcccattcatgagttctccacccacattacctaactaccacccaaaggctccacctcctaataccatcacattgaggattaggattttaacatatgaattttgggggggatgcaatcattcagcccataataccctctaacatattaatcatagttatttttaactccctgtctgatagttccaactactaggtcaactgagtctaggtctgttgttgtcttctcttgctcttttgcatctaataatttttggctgaatgtcacagatgttgtatgtaggacagtagaaactgaggtaaatagtaattattcctggaaacagccatggttgcccttttgataggccattagcatggggagattgaatccatctaatcaggagttgggctgagtttgtgtttctttgttgccagtgttacctttgctgtaccatagacttaaaattcctctattgttatcttatgcttgaggtaggcactggtttgcccagagaatttttatttttcccagaccacacttgcctttaggcctgtaggcctttcctgtgtgcctgcatctcagggagggtctctctccatgttgttgcctctatgttagtagtagacaactgttattacttggttcttgctgacctggtgagttggggggcaggggttgtcttgggccagcctcagtttttgtcaggccatgaatccctgggtcttgagggtgggattttttagtgatcctgccctcttccactggtagaaggcctttaatgatctgggcccaggatgatttcctgcccttttatcatgggtggaatttttttttccatttccctcactctagtcacagtgaatctttaactgtgtcctgagggcaacagggtttgctgcacttcttttagtggcttaaggattttgttctgtaggggagtagggtttcattggagctttgtgccatttctatgttaacagcagcccccttgcaggcctaccccatggaggtaggctttctccagtcttcttccttgtccccgtgtttcttgagagcactcagtggatgactatggagaagagcctgcaagcagagaccaactacccttaggtctacagctctcatgagtctcccgcactcagcctttagcaattcattaaaaattcttgttgaattcttactgcttgtatagtggcctcatcttccttcctgctgtaccacagatggcccaggagaggcacttgtcttttattatatttcaagctagttggttgctctgtaatcttagctctctgatgggttcgagaaaacttatgtttttgcagattacccagctttgttcttgttataaagatgggagcagtgttctttccagatgtctacatgctaggcagaaactagaagtctggacagtctccatggtctcctactatcagaatatgtgcccttttcagtgtgactttgccacttcacccatcaagaggtagaatctatttcttcaacccctgcaactgagcttggctattttgttggccaatgggacattaacaagtatgatacaagcagaggcttgagaagtgcctgcacaatgaggcttgcccacttttgcagctctttggaatcctgaacccatgtgtggaaaagcctgaactgtgctgttggaaaatgagagcgatcacatggagcagtaatggagcaaagaccagccatcccagttgagataccctacaccaaccagattttcaactgctggacatatgaatgaagctatcctaggcatgcagtcttggtcaaggcaactttggctggcagtctctgagatgaccctgaatgatccccacctcctggtattctcactcttatataatcccctcctcttgagtttggactggaattagtgacttggttctagtgaatagaatgaggcagaggtaatgggatgtcatgttcaagattggttacaaaaagactgtggcttccattttgggtgcttgcttactctctcagatggctcatcataggggaaacctgctgctacatcatgagatagccctgtggaaaggtccacatgagtgaactttgaagcatatcctcccccagtttagcctttagatgaggaccacagccaaatagcttgactgtaagccagatagcttgactcatgagggaccttcagccagaggcatcttttgagccatacgaattcctgacccatagaaactgcaagacaataaatgttgttttaagttgctaaattttagggtaatttgttacacagtaataggttaataatacactggcccagattaggaaggttctgccatccatcccagccatcccaaacaactaccagaataatggattaaaacgttaactgttttaagtcactaagttttgggcagcatgataacaacccagcaaaaagctaactgatacattgattatttattgcatttcttcctccactattcttctctaacagatgaccaatactaataaactactgtgaacactttcatgttttaatctctgctctgtgctcataatcatatatagacatacatacgttcccatgcttgtaatcagaagttatataagattgtttcctcctttgattttcaaaaatgggatcataacatacaaccatctctgcagcttgctttattattattcaacaatatttgttttgaatggttgcatgatagtttatggggtggatgtacaataatgtattaaactatttgcattgttaaaatttattcactcccattttcaacccttttttgtcactgggaacaatgctgctaaaaatattaaaagatagtttgcatagtggttaggtagataggctcaggaacccatctgccagggtttcaatcctggctctaccaatttactagtttatgtgaccttgggaaagttagttaacctctgtcctgatggttttcatctataaaagatgtacacactaccacctatcatagatttgactaagaagcatatttctttcctcgggctgctataacaaagtaccacaaattgggcagcctaaaacagcagaaattgtctcattgttcttgaggctggagatccgaatcacggtgtcagcagggtcatgctccctctgaaggtgctagggaaggaacggttccatgcctctctcctagcttttgagagcttcaggtgttatttggcttatagatgcattattcctgtcagatggctgttttctccctgtgtttcttcacatcatgttccctctgtgtgtctggctctctttccaaatttccccttttataaggacactagttatattggagtggggttcactttaatggccccattttaacttaattacctctgtactctatttccaaataaaattgtattctgaggttctggggattaggatttccacgtatcttttttgcaggtacacagttcattaacaagaagttaatgcatattgtgtagagctcttagaactatgcatggagagaatttcttaatgggtattagatacacctcacttcctgagcccgcacaggtccccctacaactctctgtgcttgggacactgaggtgggatttgagagcttgtttccggcatcttagtgtcatccagctatctaaagaaaatgtagggagtaacaggaaaagcaggcctaagaccaaagcttgtgctttgggtcgagaaggatatgcctatagaagataatgagaaggagcagccagagaggtaaaaacataccaggtgagcaaggggctcatagagaacagtgtttccaacaagtgttttaatggaggacttgtccaaattagacatcaattcatatgaggatggaaaattggttcttgattttatgacacagaggttgttgttggctttgatgaatgctattttggaagtaaatttaaacaaagcaattgagcaaactcagaggaatttctgaattcaggtggtgttacttcaccatgaagcaatttttctcatagaaaaatatcaagccattggactagattattctgtcgtttgggttatactgagaaataagagttggctaaagtagaaattacatgagatttggaaggtcaaagggaaggagcaactattgctgtgaaagtctttgaaattagagacagtgaaggacagatgcagaggtacccagcaggttccagtttttcctatcttccactctatatccagcccttctttccatcttccagccctgctgaccaacagtagccccaggtctaccaccagatgcttggctgcaggctcacaaaagcttctcatggacttctccaccagcttctcatggcagtcccacatcagcagctagatgtgcctggcttctcagattttcctgaaagctctgatttatccacccatgctaatgtctcaaaagggctggtttagtgatttctttagtcttctaactcccccttctaaaccttccccagctacctctataaattgtgcatgcatcccttattccataatgctcatagttattatgcttccctgattgacatatttatactttcttttcctgagaatttggtagatgctgctcttctaaaattgagtgatgttattaagaagtcttagacaaacttgctctcttttttcttgtatataatgtgcctttctgccatatgattctttttttattcttgaagttaaggatctatggaagcatatgctttggtcctgatctttgtgtattaattttacctgagttatagtgagccattccaatcattcatttcaaggaagttttattttgcttaacattttttctgatccatttcttctcttcttcagggacatcaattatgcatatgtaagatgtctttgtcaccttctacattcatcttctaccaatcaacatccatttcacatcattattcttttcagttttgtgtgattgactctagccttgtcttcagagacaattctccttgaatctcatgttcttcatgtttagacattaacaagcaatttgctcagatttatttacattccaggatagtaaagatagagaatgtctccctccctggagactttcccagagaagatttggttgcattccaggttaataaagattatatatatatatacccaaagaagaggatggacaataaaacaatataacattatttccctcacatcttaattatgtgtattttcaatcatgtagaaatattgaaaacacagtacaacctatataacatccatctagatttaacaatttatatgtaatttttcctgaaataccagtggtaagttatagatataacattataaccataaataattgagcattcatctcctaaaaataaggacattctcccacatacctggaatatcattatcaatctaattctatgatatatccagtccatttccaaatttctcccattgtccccaaaacatattttacagttttaatgaggtagaattagcatacagaaagtggaacttgtttaaagtgtacaatttgatgagttttgacgtgtgcacctttccaaccatcatgacaatacaaataatgaacatatcaatcaccccaaaaaagtttccttatgcctctttgtcattcagccccctttccccacattcttcccacatccacaggcaatcatggatctgttttctattgttatagattagtttgcgtttcctacaattttatacacatggaataatactataggtactcttgtttggctccttccatccagcataataagtttgagattcattcatgttgttatatgcgtctatgttcattcctttttattgctaagtgttatttcattatatggacataccagaatttgtttatccattcatgttttgatggaaatttgtatttccagcttttggctattacaaataaaactgatgtgaacatttgtttacaagtctgtgtggacatagttttcatttctcttgagtaaatgcataggagtgaatggcttagtcatatggtaggtatatacttaattatttaagaaattgtcaaactgctttccaaagtggttgtactatgttacattttaaccagcagtatataagtgctgcagttgcttcattgggtatgattattatttttaattttagtcatttaatgggagtgtagtggtatttcactgtggttttaggttacacttccctaataagtaatgctgttgagcatcttttcttgtgtttatgtaccatctgtataccatcttggttgatgtgtcttcttaaatattttgccaatttgtaaactcagttgttcgtcttattattgagttgtaagtgttctttatatatcctagatatatgtcctttgttggatgtacattctgtaaacagtttcttctaggtttgccttttcatttaaataacagaagaccaaaagtttttaatgttaacaagctcaattcatttttgttttcttttatacttcatgcttttttggtcatggttaataaatttttgcaaagctcaaggtcattaagataaaagtttttaaaaagatttatgctttcttctagaagttttataatattggctcttatatttggttacctaatccatttttattaattttgcatatgatgtaaatcctttccaaagataaggatttaggttgattttgttttgcatatggctgtccagttgttccagaaccatttgttgaaaatgataatgcattggattgccttgatatatttatcaaaaaattaattgattggttctatttctgctctagttttctattatgccagtaccactactgccagtactacaccattactgtagcttctgtactactgtagcttctgtactactgtagcattactctttgctgtagcttcataagtcttgaagtcagatcatgcaaatcctctaactttattcctctttttcacacgttttggctattctggtttttctttgaatttctatataaattttagaatcaccttgtcagttactattaaaaaaaagcctgctgggattttgagattgaactgaattcatagatctatatggagagaattgacatcttaattacattgttttcatatccataaacaggacatatcattc[139 bp omitted]ggtgaaaccccatctctactaaaaatacaaaaaattagctgggcattgtggtgggcgcctgtagtcccagctactcgggaggctgaggcaggagaatggcgtgaacccgggaggcggggcttgcagtgagcagagatggtgccactgcactccagcctggccgacagagcgagactccgtctcaaaaaatagtgctttgtagttttcaagtgtacaagccttagacatatcttgtcaaattcatctctaaataattcatatctatgcttttgaatggtaccagttatttttaaatttcaatttccaatatttctttgctagtacatagaaatataattcacttttatgtgttgatcttgtatacgataaccttgctaaactcacttattatttctagtaattttgtaaatcctgtaagcttttctacacagacaatcatgtcatctgtgaagtgtgatagtttcacttcttcctttccactataggcgctctttctttttttgtcttattgcattgactaaaacctacaatataatgttgaatagaagtggtcagagtgtatatctttgcccttttcttgatcttcagaagaaaacatttagtctttcactattgagtatgatattagctatatgtttttcatacatgatctttatcaggttgatgaagttgcctctactcctggtttgttgatagtttatcaggaataggtgttagattttgtcaaatgttttttctccatcgagattatcatatagtttttcttttttagtttgttaattttttgaattacattgactattgatagatttagtattcctggaattaaactcttcttggtcgtgacgtactaccatttttatatttcactagattcactttgctaaaaattttgttaagaatttttgcatatatgtttatgtgggatactagtctatagttttcttttcttgtattttctttgtccgcttttggtatcagggtaatgctgggctcacagaatgaattgggaagtggtacctcccctgaaagagttagtgtggaaatggtattatgcctccttttaatgtttgatacaactttccagtgaagtcatttggtcctagaattcttttgtgaaaaggcttttaactacaacttcaattccttaatagttaggaaactattcaggttgtcatattcttcttcattaagctttgtttgtatatttcaaagaacttgtctattttacataagttgtctaatttaggaacgtgaagttgtttgtcacatcccctttttatctgtagcattggaaatgatgtttcttctctcattcttgatatcagtaatttgtgtcttcactttttttctcctgatcagtctggctacagtttctcaattttattgattttctcaagaagcttttagtgtccttgattttctctattgtttttctattttggattttattgatttatgctcttttctttattatttcctttttctgcttatttgacttaaatgtgctcattttcggccaggcatggtggctcacacctgtaatcccaacattttgggaggccgaggtgggtggatcatttgaggtcaggagttcacgaccagctgtgccaacatggtgagatcctgtctctactaaaaatacaaaaattagccgggtgtggtggcgcatgcctgtaatcccagctactcaggaggctgaggcaagagaattgcttgaacccgggaggcggaggttgcactgagccgagatcacgccactgcactccagcctgggcgacagagtgagactctgtctcaaaaaaaaaaaaacaaaaaaacaaaaagaagtgctcattttctagtttctatggttgaagctgcagtcactgctttaagattttccttcttttgtagtataaatttttagtgatataaattatcctctaagcactcatttagtagcaactcatatattttgatgtttttacatttttacattgatactgtattgtaacgatatttttacattgtttttacattttcattcattcaaaatacttcctaacttactttaggatttcttgtttgtcccataggttatttagaagtgtattattcagtatgcaaatatttgagtattttttacttatttttccctatgatttataatttgattccattgtggtcagagaacatactttataggacttggatacttacaaattaactgagatttcctctatggccctgaatatggtctgtattgttaaaaagttccatgcatacttataaagaatatgtattctactatcattgtatggcatgatcgatgttaattaagtcaagatttttgatagtgtggttcaagccttctatagacttacagattttcctatacagtagtccccctcttatccacgggggatatgtttcaagactctgagtggatgcctgaaaccatggatagtactgaaccctatatactgtttttctgatcagataaccaatatggctactaagtgactaacaagtggatagcatatacagcatgaagatgctgaaaaaatggaggattcactcccaggcaggacagagtgggatggtgtaagattttatcatgctactgagaactgtgcacaacttaaaacttacgaatttttaatttctggaaatttccctttgatatttttggactgcaattgactgtgggtaactgaaactatggaaagcaaaatcacagataaggggggactactgtatttattctatcgattattgagggagaggtattgaaatctctaactaaaattatattttttctatttctccctttagttataccggtttatactttgtctattttgaagctctgttattgagtacacaagcatttaggattgttaagtcctcttgttaagtagacacttttatcactatggaatgacactattctggtaaaattcttgtattacaatagccactccatttttctttttctcagttttagcaagtatgtatttttccactactatctacatatcttcttattttaaaatgattttatacttacaggagagttataaagataacagagtgttcccatatacccatcagtcatattcccctaatgttaacattatacataatcctgatagattttctcaaaattaataatagtattaattaaactacatacttcattgagatttcccttgttattttattactgactgtgagtttggaggtcccaaagaccaccttcagattcaataatccactagaaagactcacagaactctgaaaagccactgtactgacagttacagttcattacagtgaaaggatacacactgaaatcaacaaggggaagaggcacatcaggcagagtccaagagacaccaggcatagagtttctagttgtactctcccagtagagtaatgcagatagcacttatttctatgagcaatgatgtatgacaatacacatggaatattgccaaccaggcagattacctgagccatgtctagagtttttattgggagttggttacatagacatgactgagtgcctgcattgctgaccttaattctccagatcctccagaggttaagcgatactgcatggctgaagacccccaggtaaccaaggacattcttatcaagcaggacattccaagggcttagaggttacctcctaggagccaggaacagaaaaccaaaacttctttgagcaagattaatcctttactgcatactgaccttttctgttccaggatccaatccaggatatcacattgcacttagttgtcatgtttccctagtctcttccaatctgtgacagctcttggtctttctctttcatgaccttgatgcttttgaggaatagtcatgaatattgtagaatgttcctcaatttggtttcatctgatttttttttatcatgagcagattgaggttatgaatttgagggatggatatcaccaaatcttagtcccttcttattgaattatttcaggaaacaagattatgtcaacatgatttattactagtaatgttaatctttatcactttgttatgatgttgtctcctgagtttttctgttgcaaagttattactttttctctttccatacttttcatcagaagtgagccaaagtcccactcatactaaaggggagtggcattaagctccaccttctggacagaggggtatcaaagactttgtggtcatatcttaaaattaccacaggggaattgctttgatgttacacagataatctgtttctccttaaaagttttgcccagtaatttcagcattcatcagtgaatcgtgccttcagcaactactgtgtttttctaatagtgattttctgtttccttcattgctttcacaattgttaattgggattcttctgtaaggaagatatgtcctgtctcccctgcttatttgtttattcagtcatttacttatgtcagtatggatgaagggacatttattttattctttgtattataatcgaatagtacattattaattatgtggcacaaattgttacaggtttggctattgttagatctttcaggttggttcttgtgttccctttacatgaccccatccttttattggtagttgcggggggcattttcttacttcctggaactataaggtggtccaggctcatcttgtattttccttgtcccagacaaagaattcgctatttatttctccaaggagatctggttccttttgctggaaaatggcatttggaaatcaagctcttaagattaggtgtgttcattgttactggtgtgtcgctgctaggaatgtcacagagctaggaaattcatgtatgtattctaatccatgtgtgcacacatacctattttt[140 bp omitted]atggtgaaaccccatctctactaaaaacacaaaaattagccgggtgtggtggcagtcgcctgtaatcccagctacttgggaggttgaggcaggagaattgcctgaacccaggaggcagaggttgcagtaagccaaaatcatgccactgcactctagcctgggtgacagagcaagactccgtctcaaaaaaacaaaataaataaataaataaattaattaattaattaattaaaaaaacataagttcatactgacatctccagctcaaacccagcactacagggttccttctagccttctccctgcccttgcttatttttacttctttctccataagtcaggaaagaaaaacagttgactacatttgtgttggcctatttgggggttctctattctgttcttttgatctttatttctggctttttgtcaataccacactttcctcattactgtagctctacagtgagtcttgaaattgggtagttcaagttctccaactttgttttctcttttcagaattgttttggctatttttgctcctttattttatcatgttaattttaaaatcagcttgttggtacctcaaaagggctttctgggaatgtgattgagattatgttgcatctatagataaaattagggagaattgctatctcaactatatatatatatatatatttattatactttaagttttagggtacatgtgcacaacatgcaggttagttacatatgtatacatgtgccatgttggtgtgctgcacccattaactcgtcatttaacattaggtatatctcctaatgctatccctcccccctccccccaccccacaacaggccccggtgtgtgatgttccccttcctgtgtccatgtgttctcattgttcaattcccacctatgagtaagaacatgcagtgtttggttttttgtccttgcgatagtttgctgagaatgatggtttccagcttcatccatgtccctacaaaggacatgaactcatcattttttactccatgagcatggtctgtctttccatttatttagatcaggggtgtccgtccaatcttttggcttccctgggccacattggaagaagaattgtactgggccacacataaaatacgctaacaataatgatagccgatgagccaaaaaaaataaatcacaaaaacatctcacaatgttttaagaaagtttacgaatttgtgttgggccacactgaaagccatcctgggctgcatgtggcccgcaggctgtgggttggacaagcttaatttagatgatcttttatttttcttttttaaatttttcagcatatagatctcacacatatttatgtatacacacacacacacccctaagtacttcatttttggcaatattgtagatgttatattttaaaatttcaaattctgattgttcatagatagtacataggatacaactgacttttgtatatgacaacgtatcctgtaactttgctagctcacttactagttctgggtaattttttttgtagatttgtactattttctacatagacaataacgtctggaaatagagttgtatttcttcttttccaatctgaatgctttttatttcttttccttatcttattgcgctgtctagaacttgtagcataatgttgaataagaatgatcaaagaggacacctttgccttgcttctgatcttagggagaatgcatgcaatttctcttcattcagtatgatataacttgtaggtttttgtagatgccacttattgggttaaataattttcattctattcctagtttgctatgagtttttaaaaatcacaaatggatattcagttttgtcaaatcctttctctgcatctactgagataattatacgatgtgttgtatttagcctgttaatatggtgaattacaatgattgattttcaaatgttgaaacagccttgcattcctggcatgaacccctttgttgtgatatgtttttatatctatatataaaatcatatttacatatatctatatataaaacgaatattttggggaagatttttatgtcatgctcgtgagggatattggtctacagttttttttcctgtcgtatctttttctggttgtggtatttgggcaatgctggcctaataaaatgaattgggaagtgttccctcctcttttttctggaagagtttatgtgttgtgaaattttggcaaggatatggagcaattggaactctcatgcgttgtttgtgggaacgtaaaatggtacagcctctgaggaaacagtttggtggttcctcaatcaatcaaatgtgtagaattatcatatgacccattaattctactcctaggtatatacccaaaatacagattctccttgacttatgatggggttatgtcctgataaacccactataagttgaactatcacaagtaaaaaatgcacttaaacattcctaacctactgaacatcacagcttagcccagcctaccttaaatacactcagaacacttacattagcctacagttaggcaaaattatctggcaacatagaacacaatagagtattggttgtatatgttgggttattgtaaaccacaaaaataaccaagtttctttgtcaattgtgtttctaactgtatccaaactggacattttgttatttacagacaattgttattttgttttaattctcttcaaaacatggtttatattcaagctgtgggactttaacaggtgctctcaaatgcaggtttccaacaacaacacacacacacaaaagaagtacagaactcataaaaagcgaaaatgtttataaatatcaagatatcaagcaaaacaaaagttaataaaattgattaaaccaataaaaagcaaaaacaagtttttaccttttgcttagaacactgctaatccttatcttacttttcgaagtcaagaaaacttgtcttaagctagctacagcctttaacaactaagtaaattatactcttgtaaataggatttaaagtgtgtttgtttctctctacctagttcctctacaatttgaaaactagttataagttttcttaaattacaacaatatcgttgtttgcatcagtgcaataagactctgttttcttttgtaacagaacgcaatgggaaaaactggttgttttaccaaggctttgactggaatggtgtgctctcctttaaggaatcaaacttaacttatggaaccaataaagcccttggaaaactggccttatattttgtgtacacagtccctgtacagggtttgtgatctgtagtaagtaaagaatgtcactttctaacaggccaggaaccccaagttatcttaaaacctcaagagaaaaggaatttgcccaactcataggtatttgatagtacaaatccatggctgggctcggctttaaaaagtcttatcccaaattccttctatgaaacaaagttccatcaaagccaatttaaaaggcctatatagcaaataattattcttgctgcactgtatacaaataattaagccaagtataataaagcaaaccagtcctaccataatttgtcttttaataaaatgggaaactggagaatgaaaattatgtttcaaaaactgtagcacacctgttgttaaattctagccttgcgtaatgtttttcaatttttatcatttgctacagtttaaattatatcctttagaaaaaccaactcctggttacatcacactcaagtcaaagcctgaaaagctaaggaagcaacccctaacagcccagagaaacatcctaaatatcaatgtaaagaaataagaaatcttaagctgaaaatcccaaaaataagtaactgagtgagaattactcatcttactcagtctcacccctacaaatactttttgtcgtttctctccttttaagccaaatattaaaacctttttaatggaaattatttactatgccacccttgtgggaattgctttactcactctactatttgcagtaggactatatgctgtagcaccctcagggtggaatatcagaaaatctcaattactgtagcattttgcttaattattagcctcatagcaggaataacagttactaacaaaaaaataacacacgggcctttccaaacatgcggctctgcctctcattgggtgaggaatgtttctatctcaaccagttgggcccagtaaaacgtgctgctgaaaaactaaaaataataataataaaaggggggctaaagagctaaggaaataccaaaacaaccaaataaattattggtttaaaaacaaaatcacagcatgggtcaacccattcctgggccctctcctaataatatgcctaggactaatgttcttgccctgcctaattaacatttttcaaagatttttaactgacaggatcacggccacctcacaggcaagtacccaaaaacatctacagatggtgttgctccagcagtcaatccgagaccaagaaactctccgccccacccctcagcaggaagtagccagaaagaacacatcgccccttgtccttttataactatagggtctgcaatgacagagcaggagtactgtcatctcagacaaacaccgccactttcagttccagctccctttctatcctcatgcatttcaaggaaatcacttctctcctaactgcaagcaaccagaaaagagcagacagtaaaatacagataagacagctcaggcactgagctggggcgggcagcggcaggggcgggcggcgggggatgtctcttgggtaactgccaaacttcaccgtcatacaatgggccccatgaaacagtgggtcttaataagcacattccttccccttcaggtgcagtaagatagggaagctaaaagcagactctccggggggcggggggaggggtgcggcggtatgcctgcagctgcaggaagatgtatggggacagacacataagtctccctcccagataagcacaactaagagacacaaaagcagtcaaagtctctgataaactctcctgccctaaatccttaaaaactcttacccctctcaggtgtatttctctaaaatgaacctgtctttgactgttgagccacctttcatgtttctttcctctttctttaattcttacagtatacccttgtgaacacatgaatgactgggagctgtggctcgctaccactgcccagcattgtgagagactgtcataccactttctactcaatgtgtcatgtttacaccattgtaaaattgaaacgttgtaagttgggggaccatctgtaattgaaaacaggtgttcaaagaaaaacttgtacacttacattcgtagaagcactagtcacaaaaaccaaaagatagaaactacccagtgtccatcaaccaatgaatggataaacaaaatgtggtatatctatacaatggaatattattcagttataaaaaggattgtgtcatggatatgtgccacgatatggataaactttaaaactatgctaagtgaaagaacccaaacacagaaggccacagtattttatgatttaatctatatggaatatccagaataggcaaatctgtagagacagaaagcagtagtggttgccaagggctgaggtgagagagtgggaagtgattgcttagtgggtatagagtttcctttttgtagtgatgaaaatattctggaattagatagtgatgatagttgctcaaatttgtgaatataccaaatgaataaccattaaaatggttagaatggtgaattttatatgtatatttgaccacaataaaaaatggatcatagatctaaatgtaaaacataaaagtgtaaaacttctagaagaaaacaaggaagaaaacctcatgatcttgggtttgcaaagatttcttagatatgacatggaaaagcacaatccattaaaatgtattgataaattggatttttaaataaaaaccctgtgctgtattaaaagaaaacaagccaaagactagggtaaaataattgcaaaacatatacctgactcatattaagaatatgtagatcaggcatggtggctcatgcctttaatcccagcgctttgggaggccaaggcaggaggattgcttgagccaggagtttgagaccagcctgggcaacatagtgagacctcatctctacaagaataaaaaactagccaggcattgtggtgcatttctgtagtcgtacctactggagaggctgaggcaagcggatcttgagcccaggagatcaaggatacagtgaactatgattgtaccactgcgttccagcataggcaacacagcaagaccctgtctgaaaaaaatatgtaaaacaactctcaaaatgctataagtaaacaacccataaaaatgggcaaaaatcttgagcagatgctttaccaaaaaatgacaaataagcacatgaaaatatgttcaacattatctgtcattagggaaatgcaaactacaaccacaactaaatacccctacacacctcttagaatggctaaaataaaaaagtctgaccataccaagtactttaaaggatgtgggccaactggagctcttatacattacacagtttcatataaaattaatcataccactcagcaatcccatttttaggtattccacccaagataaataaaaacttatatacacactaaaacctgtgcatgaatgttttaagcagtcttactcacaattgtcaacctggaaagaactcaaacgcccttcaactggtgtatcatgactgtggtgatggctccacacatttatcaaaacccatagaaatgtataccaaaagaagcagatttgactatatggaaaatttttagaaaggatttgggggggaacccaaagtggaacaca[132 bp omitted]gaaaccccatctctaaatacaaaaattagccgggcgtggtggcgcgtgcctgtagtcccagctactcgagaggctgagacatgagaattgctagaacctgggaggcagaaattggagtgagccaagatcgtgccactgcactccagcctgggtgacagagcgagactccatctcaaaaaaaaaaagaaaaaagaacccaactatcttataaattaataacactacactgaagggggtgggcagaaaagacagaaatacataacttaggacatagtacttttattggatactgtaagggtatagacaaaaaacattattctctagttagtaaatttgttgttctcaggggtatgagttagcaattctgaaagttctttatgttaatactagagttgaacaagtaagtaaatatatcatagttagtgagagctagatttctcactgttataattaaggaaatgggaaaggctggaatgaatcctgtggtgttggattggaatcagaggtggagagagagagagagacagagagagaatgagaatgaatatatgtgcatgcatgggttaatatatatacatatatttccaagctttcaagttagctgagagggtctagaagcaataataactcagtaccagtgagcacatatagcagtcagatcttggtttttaaataccattctctaataaaaggaaccagggttccatgaaaaagtagttgaattggagcaccttctagtctgaaaaggtaatgaagtgcttttttaaaaagatggaggcatatcaaaagagcaccataaactaaactgaaagagcttgcagtggccaaagctggaataatttgagacagaaaataaataatgatagattataacccatagattaaaataaatatgtgtgagtctaaattgttgtaaataaataattgaataaataaataaatgggggtaaaagggacaactcttccttactgaataattctaattaacaaatgtagaaagagtgagggaagtagaaaattgttattagaatactacagtaataattgttgcagggaagattgacccatgggtgctaaaattagtgggtaaaaccttgatgagaaagtgtattcacatagtttcaaagtaccttcccaagatatttattaattacaaaggaaaaaatagtaactttatggtgaaggaacctagtagataccactgggttaatcaagtgatctaagttaatatcaccagtaagatgatgtagccattatgtgaccactgatataatgcactgagaaggacacattgcttctgtagtattcttgccaaaaatgtgtaacctcaatctaataagaagacaggctgggtgcggtggctcacacctgtaatcccagcactttgggaggccgagatgggtggatcatctgaggtcaggagttcaagaccagcatggccaacatggtgaaaacccgtctctactaaaaatacaataattagctgggcatggtggtgtgcacctgtaatcccagctactctggaggctgaggcaggagaatcgcttgaacccaggaggcagaggttgcagtgagctgagatcgcaccattgcactccagcctgggcgacaagagcaaaactcagtctcaaaagaaaaaaaaaaaaaaagacataagataaactcaacttacaggacattctgcaaaatagctgaccagtactcttcaaaagtgtcaaggtcatgaaagataaagaaagaggaagggcctcccacagattagtggagactaaagtgacatgaaaactaaattccatgtggtatcttgaattggatcctggatctgaataagggacattagtggaagaactggcgaagtaggaataaagtgtgtaagtcagttaataatattgttctaatgtcaatttctactttttatcattatatcatagttataaaacatgttaacatgaagggaaacttggtgaagggaatataagaactctgtactattttctcaacttttttataagtctaaaagtatttcaaaataaacagttaaataaaagttcatgaatgatcatgatttaagaaatctaggtgtggaattgttggtcacatggtaagtatatgcttaactttacaagaaactgtttaactattgaactgttgacctttacaagaaactgctcaaccgaggtggttataccatttcacactcccaccaggaatttatgggagcttcagttgctgtacatcttcaccaacatgtggtagatcaatgtgtattatggtagtcagcttctaagatggccacaatgatacccacctcctcatattcactctcttgtgtaatccctttcctgagtgtagactggacttactgattaactttcaatgaagagaatatagcaaaagtgatgtgaagacacatccaagattaagttatgaaaagattgtggcttctgtcttgggtactctagcttggatgacttgcactggcaaaagaaagatcccatgttttgaatagccctattaagaggtccatatggtgtagcaaggaccaagatccttagttcatcagcccacaaagaattgaggccctccattcaggacccatgtgaatgagcttaaaagtgtgtcctccaggtccagtcaatcgttctgatgactgtatccccacgtgacatcttgactgcagcctcgtgagagaccttgagtcagaggcacccagctataccactcacagattcttaacccacagaaactgtgacataattactatttgttattttaaactgctaagttttggggtaatttgttactcagttaaaccacactgagatattatcctttacctataacgttggcaaaaacaaaaacaaacacaaaaacacccagttgatgagagagggggcacatgcagtctcatacagtgatgttggaagtgcaaaataaaaatattacagctcttttggggctaatttagtgcttctaacaaaatcagaaaattatttacctttgactaagcactctcacttccggaaattcatcctacaggtgtacaatgtaaaaaaaaaaaaaaaaagttgtcaagagaataaaaagacaagtcacagattctgagaaaacatttgcaaaagatatattattcaaaagatacaaagaactcttaaaactcaacagtaagaaaacaaacaacccaatttaaaaataggcaaaagacctcaacagatacctcaccaaaaaagatatacagatggcaaaccaataagcatatgaaaagatattctacatcatatgtcactagggaattgcaaattaaaacaatgagatgccaccacacctgttagaatggccaaaaccagaacactgataaaaccaaatgctgacaaggatgtggagcaactctcattcattgcttgtgagatggcaaaatggtacagcaactttggaagacagtttggcagtgtcttacaacactaaacacactctcatcatatgattcagcaattgtactccttagtatttacccaaaagatttgaaaatttgtgtccatacaaaaacctgcacatggatgtttgtagcagttttattcgtaattccccaacttggaagcaactaaaatgtcctttagtaggtgaatgaatgaattggggtatatccagacaatggaatattattcagcactaaaaagaaagatgctattaaagccatgaaaatgcaaggctgagacttaagtgcatattactaagtcaaaaaagccagtctacaaggctatgtactgtatgattccaactatatgacattttggaaatgcacaactatggagacagtaaaaagatcagattgtcagaagctggggagaaagagggatgaataggcagaacacagaggatttttaggtcagtgaaactactctggatgatagtataatggtgcctacatgtcattttacatttgttcaaacccatagaatgcacaacataaagtgtgaatcctaatgtagatgaggcactttgagtgataataatgtgtcaatgtaggttcgtcagttctcacagatgtatctctctggtgagagatattgatagaaggggaagctgtgggggaggacaggaggagtatgggaactctctgtacttgctgctcaattttgctataaacctaaaacttctctaaaaataaagtctatgaaaaaataaaatatagacatagttatattgcagcattgtctgtttatactattaaaagactggtaacttaattgcccatcaatagaaacaaaatatggcaatatacacattggaatacactgaaaccatgtagagacagatctctagaatatattgagaagagaaaaccaaactaggtatagaacagtgtagtaagctcaattttgtgtgagaaagggggttatatatctatatatatgggttaaatatatatgcaatatacatttataaatatatatttttatctatttgcaaattatacatatttgcaaaaagaaattcaagtaaacccatgagctaatgaagtaaaattttaccaggatctacgcatgtctgtatgtgttagacttaacttatgtatttttatatcacattgctttttgaaccacataaatgtattaccaatgtattacctattcaagaaaaataaaatagtataaccctagtgcggggggagtgggagaagctattagagttccaaaaacactcccccaccatcagtttcccacttagttaggaagttataggtgtgagttgtagggaggattaaacagcaagaatatggttcacatggacagcccccacccaggctacaatccactgttgttgggcttcctgatgaatgtttatggagagaaaacactaacagagatggggccattgtgttcagggaactagatcagtgtcccttcctccactggaacacagggtccagatcccctccccatcctcacaggcctctgagaatcaagagacgtagatgctctctgagataatccttgtcttctgctagaggcagatggcaagccgggctgggagaagtcatgcctcaacttcccatctttgttcctgaaagctcctaaggtggactccacccaactttcttgctgaccgctgcttttttcctccctctgtccatgatcactcataggcacgtctgcaaatgttacctactgcacctcaagtctgtttaatgcgacttggacttgagtaagtctggacagactcctgaaaatatcctgcgatggatgtcacaacaggaggctctagaagggctgggaatgccacctcttgatatggctgtttgggagtagcctgggagataggtctgcacattgtcttctagagaccttgaatctgtgaatccctgacccatttctgcctccctgcagttattttgactcaattcctaaccaaaccctccatcacctaggccatatactattacctgacaaacttcagcaggaccacctgcctaccttttttccacatctgtctccccaccagaacacaagcacctcaactccgctctggtagtgggagtggggtggattcctggagcccagtagctcctgttgaactgctgagaactcagcccctgacaccataaacatccctcagtcccagtgttccttttcctcttgcccctcaaaaacaattaaggctcttgaaagggccagaacttctggttcatggaaaaatcccaaaataaagatcaatgtggttatatctatcagaggacataccccagcatgatatttctcattgcaggcacaagtctcattcccttcctgatatggtttagctgtgtccccacccaaatctcatcttgaattgtagctcccataatccccacaggtcatggaagggacccagtaggaggtaactgaatcatgggggtgggtttttcccatgctgttctcgttatagtgaataagtctcacaagatctgatggttttataaagagcagttcccctgcacatgctctcttgcctgctgccatgtaagacatgcctttgctcttcctttgccttctgctgtgattgtgaggcctccccagccatgtggaatgtgagtccattaaacctctttttctttatgaattacccagtctcaggtatgtctttattagaagtgtgagaacagactaatacacttgccctctgtctttccctctgtagagaactctccctctggcccaactccaccagtgcaggtatccagggctgccctcctaggaactcccccagctcccaagacactgccccaaggaccagccaaccacagctaaatctatgcccatcccagtatgtcctggccctctggagctaaacactcagagacagatactttgtgctgaccattgggacatggcctctgtcccctgaaggatctttaggaatgggtcccacaatcctttctattatcatttttgctgtcccaaatttgatttagaaatattaatatgaattcatgatatatcttctcttaaaatgtatattttctcactctgtttcattaaaaagaactggaaatccagagccatgagcatgcgtagcacccagactgtgatctcacatatcatttctcgctaaggctccttggagaaatgttggattccaggtctggacaccaaagatacatgataaacctggaaaatagaacatcggaaagcaaagacactctcaaaaagtactaaattcatgtcagactcagaagccaacccaaatatgttcccatcagccaaagatggaacaactatgcatcaataggaataataactgtaatggattaaaatacaccaaatgtgtttaaattcatgaattcacaatgatacttttaaaatattgttggtcatctttggaggatgctagagaatcatctcattatttgataattggtttgaaaaggaaataattaagcatttatcctgactttcttaagtgaactatacttcaatgaaatgagacagttatagaaagaatgagagaattagagttcaccatggtgaattaatggatatagaaagtgatcatcaacaggtgataccattataacaagagagatgaccagccggctgtggtggctcatgcctgtaatccaagcactttgggaggctgaggcaggtggatcgcttaagcccgggagctcaagaccagcctgggcaacatggcaagacactgtctctacaaaaaatacaaaattaaccaagctggtggcgcatgcctgtggtcccagctacttaaaaggttgaggtggggctgggcacggtggctcatgcttgtaatcccagcactttgggaggccgaggtgggtggatcacgaggtcaggagatcgaaaccatcctggctaacatggtgaaactccttctctactaaaaatgcaaaaattagctgggtgtggtggcgggcgcctgtagtcccagctactcaggaggct[136 bp omitted]cccttgagcctgggaggcagaggtttcagtttgctatgatagcaccactgcactccaacttgggcaacagagtgagaccctgtttcaaaaaaagagagagagagagatcaccagtcaatatgtgtctcttgtaatggtcttctatgcgatggtcttaaaaaaaaaaaagaataaaatttgaatgtgatcaacctctagataagactgtctatttgtaggaaatgcaaaggatagaaaaacatgtttgacaacatcataggaatgtaaccagcaatatgcatactgtgggaaactgtacaggacaaatggcctgggttttgcaacaataaataaaatgtaagaaaaaccattatagaagagaatctatagattaaatacatgtaaagaaatatcaaccatttacaatgtggtgcaccttgtggtgtatagaccctatggttacctcatgattcctgtcacttggtattcatgcctttcataattccctctccttgagaatagacaggacccatgacttgcttctagccaaagaatatagcaaaggtgaaggaattttgtatatatagtcaaaatcacagatcagttgattttgagttaatcaaaaggaatactgtagtcaactgtaacacagtggtaagtatttgtgtatctaaacatagaaaaagtatagcataaaagttaaaactggtatacctgtacagggcacttaccatgaatggagcttgcagaactgaaaggtgcactgattgggtcagtgagtgagtggtaagtgaacatgaaggcctagaacattagtatatactactatagactttataaacactgtacatttaggccacagtaatttttttcaaagagtttttcttcccccaataataaattaaccttagcttactgtaatttttaccttataaactttttgtgttttaaattttttagaactgttttactcttttaaaataacacttagcttaaaatacagtcacattgtacagctatacaaaatattttttctttatatccttactctataagcttttttctattatatttaaacattttattttactttttttcaactttttgttaaaaactaagacacaaacacacattagcctgggtctacacagggtcaggatcatcaagatgtcactaggcaataggaattgcagctccattataatcctatgggaccatagtcatatatgcagtctgtcattgactaaaacattattatgtggcacatgattgtaataatggaaaacatcccacagaggagtgaaataaatatgtaggtctatgatgcccaaagaaccccaaataggctgaacattaaaagatcttcactgacatatattataatcaaattatctaaagttaaggacaaggagaattctgaatgcaacaagagaaaagagagtatgtgtaaactatcatatatcagagaattcccgtaagactatcagtagctttctcaccagaaacctttcaagctaggaaagagtgggatgacatattcaaagtactgaaagaaaaaaattgctgtccaagaatactaaacctggaaaaatattctttaaaaaggaaggagagataaaatctttcccagacaaataaaaactgagggagttcatcactagacctgccttataagaaatgttcaagggagttcttcaaattgaaatgaaaacatgctaaacaacatcacacatatcaaagtataaatctcactagtgaaggcaaatacatagacatatacagattaatataacactttagggatgatgcatcatttgcttttaaccctgatataaaagttaaaagataagaatacgttaatggatacacaatataaaaagaagctaactctgactacaagaatacaaagtgttgggacagggtgagtaaaggtacagtgttttggggtgggattgtacttaagctgctatcaacctaaaatagaagggtgtaactacaagatatgtatgcaagcctcaaggtaaccacaaagaaaaagcctataatagattcagaaaagataaagggaaaagacaatacaagaaagtcactataaaaaaaatcaccaaataacaaaggaagacagcaagagaggaaaagggggcaaaacaactacaaaatagacagaaaacaattaacaaaatggcaatagtaagttctcacttatcaataagtaccttaaatgtaaaagaattaaaataactaatcaaaaagcacagagtggctgaatggataaaaatacaaaacaggatccagcaatatgctctctacaatagactgcgtttagatttaaagagacacataggctgaagtgaagggatggaaaaagatatttcatgcaaatggtaaccaaatgaaagcaggaatggtgatacttatatcagaaaaagtagattttatgtctaaaactgtctctaatacataaaatgtcatgaaataatgacaaaggggtgagttcaacaggaagatttagcaattataaatatatacacacccaacatcagagtacctaaatataatgctatggtttgaatgcttttgtcccctcaaaaacccatgttgggcaggacacggtggctcatgcctgtaattccagcactttgggaggccaaggcaggtggatcacttgaagtcaggagttcaagaccagcttgggcaacatagtgaaatcctgtctctacaaaaattacaaaaattagctgggcatagtggcatgcacccatagtcccagctactatggaagctgagatgggaggctcgcttgagcctgggaggttgagccatgatcatgccactgcactccagtctgggtgacagagtgagacccagtctcaaaaaaaaaaagaaaaaaagaaagaaagaaagaaagaaagaaagaaagaaagaaagaaagaaagaaagaaagaaagaaaaagaaaaatgttgaaacttaatccccaatgcaatagcattgggaggtggggcctaatgggaggtgtttaggtcatgagggctccaccctgatgagcaaattaattctgctataaaaagggcttttaggagtgagttcactctctcttctgctagtctgccatttctgcaatgtgaggatgcagcaagaaggccctcaccagacactaaatgccagtgccttgatcttggaattcccagcctttagagctgtgagaaataaatttctgctatttataaatttcccagtctcaggtattctgttacagcagcacaaaatggactaagacatatgtaaagcaaatattgaccaatctgaagacaggtattggcagcaatacaataagaatagagggctacaataccccacctacagtaatagataaaacattcagacagaatatcaataaaaaacaactgacttgaatgacactacagaccagatgtacctaagtgacatatataaaactttctgcccaacagcagaagaatacacattcttctcaaatgcacacagaacattctcaaggatagatcacatgttaggtcacaaaacaagtcttaacaaatttaagatcaaaataatttcaagtatcttttctgaccacaatggaatgagactagaaatcaataatagcaagaaaaccagaaaattaattttaaaaaaacagaaaattcacaaatatatagaaactaaactacacacttttgaacaaccatttggtcaaatagaaaatcaaaagaaatttttaaactatctcaagacaaacaaaaatgaaaacaaacataccaaaacatatgggatacagcaaaagcagtactagcagggataaatgtctacattaaaaaagaataaagatctcaaataaacaaactaattttacatctcaaaaaactggaaaaagaacaacaaactaggcccaaagttagcagaaggaaggaaattataaagattagagcagaaatagagaattagaaaacagaaaaaattaacaaaactaagagttgatttcttgaaaagataaaataaaccaacctttagctagaataactaagaaaaaagagagaaggtacaaatgaatgaatcagaaatgaaaaaggagatattacagcagaaatgtgagacattgcctgagaaataaaaaggatcacaaaggactgttatgaataattgtatggcaacaaagtgggtagcttagaagaaatggataacttcctagaaacatacagcctagcaaaactgaatcaaaaagaaataggaagcctgaacagaccaattacaaataaggactttgaaccagtaatcaaaaacctcccaacaaagaaaagcccaggactaggtgccttcatgggtaaattctaccaaacattcaaagaagaattaatactaatccttcttaaacaaagaagaagaaggagaaggagaatgagaaggagaaagaggagaaggagaaaaggaggagaaggagaaggagaaggcacacctccaaactcattctatgaggtcagcatcaccctgataccaaaaccagacaaaaacactacaagaaaataaaactataagccaatatccctgatgaacacagatgcaaaaaatcattaatagaatactaaaaaactgaattcaaatgatcatatacgatgaccaagtgggatttatcctgggatggaagggtggttcaacaaccttccaaattaaatcaatgtgacacaatacattaacaacatgaaagaaaaaataatcatctcaatagacacagaaaaagcatttgacaaagttcaacatctattcataattaatagaacaaaattctcaacaagatgggtatagagggaacttacctcaaacaataaagaccatgtatgaaaactacacagctaatgccataatcaatggcgaaaactgaacactttccctctaagatcaggtagaagtcaaagatgccaaagccacttcttttccacattgtattggaagtcctagccaaagcaattagacaagaaaaagaagtaaaagacatccaaattggaaaagaagttaaatcatctctgtttttggataccattttcttatgaataggaaaaacccttaaaaagccacccaaaattgttagaacaaatacacaaattcagtacagttgcaagatacaaaaccaacccacacaaatcagctgtgtttctatccactaacaacaaattagcaggaaaataaattaagaaataaactcatttacaatagtgtcaaaaagaataaaatcttagcaataagtttaaccaaggagggaaaggtctgtgtgctgaaaactataaaatgctgatgaaaaaaaaatgaagaagacacaaataaatgggaagatatcctgtccttatggattggaagaattaatattgttaaaatgtccatactacccccaagtgatctacagattcactgcaatctctatcaaaactataatattttccacagagattgaaaaaacaatcctaaactttgtatggaaccacaaaggatgctgaatagccaaagtaatcttgagaaagaaagacaaagctggagcatcacacatctttttctttctttctttcttttttggagatggggatcttgccatgttgcccaggctggtctcaaactcctgggctctagcaattctcccaccttagcctctggagtagctgggattacatgcagaagaatgaaattaggcccatatcctacaccatacacaaaaattaactcgaagtgaattaaagacttaatgtaatgcctgaaaccataaaactcctggaagaaaacataagggtttgctccttgacatggttttggcaatgatttttttttgatatgacaccaaaagtacatataacaaaagcaaaaataaacaagtggtactacatcaaactgaaacctttctgcataaaatatatacaaactatatatctaatatatttaaggaactcatacaactcaatagcaaaaatcaacctgattttaaaatgggcaaaagacccaaatagacatttttttccaaagaagacatacaaatagccaacaggtatatgaaaaggtgttcaacatcactaatcattaggaaagtgcaaatcaaaaccacaataaggtgttactcacacctgttagaatagctattatcaagaagacaagagacagcaagtgttggtgaggatgtggagaaaagggaacccttgtatactattggtgggaatgtaaattggtatggccatcataaaaaacagtacgggtgtttgtgaaaaattaaaaatagaactgtcttgtgatccagcaatcccacttctgggtttatattccaaaggaaatgaaatcagtacctagaagaaatatctgcacccccatgtttattgcagcattattcacaataggatagccaatatatggaaacccctgttgggtttttcttaaccttctttcagtgacatcttacttccatttaaaccaattccttgtaacagatcaaacactccttgtaataaatcaaccaacttgtaaggtaactggactcaatctctgagagacttttttgatttcaaacacaataggccagaagaacaaaaagctaaactccttatcgtatcatccctaaagatggagattgctctctccactgaaacaatacttggaaatattttgtgaattttgagttttagaactgaactttcaccaaaatggaattgagaaagctttgaggaagagacggtgtatattcagaggctacctcacttttgtacaacttgtcaaaaaggcatattacatagactcaacccaaagttctttaggtttagatctacctgagggtctctgttactaaaaatggcaatgcttggcaccagaccactcttgctattcaacataatattcaacatattatgatactatttgacaccctataggggttattttattttggccaaagattgatc[143 bp omitted]tctactaaaaatacaaaaattagccgggcgtgctgcaggcgcctgtaatcccagctacttgggaggctgaggcaggagaatcgcttgaacccaggaggcagaggttgcagtgagccaagattgcgccattgcactccagccttggtgacaagagcaaaactcggtctcaaaaaaaaaaaaaataccttggtcagcagtagggtgtagatgatcagggtagggtgttccatcagtggatgtgtacttgacactagcgagggtacgagcttctcaggtaagaaaagggcacagcaacagagtaggggttaaagtcagaggtcacctgtggccagaagtagggatcagtttgtcctttgggtatcgctcaagtggtattagtggttcagaggtgatgagtgcatgtcctgggtgtggggaacaggtccaggtgtgtcccacggtatcttcagtggaggacgtgggcggcagatgagggcgcctctctctgcagatggtggcaggtggtttgctgctccatggggtgaggagacacaggctgaggatggtcctagtgggtggtcctcgcatatcctcatcaggattgaagggaagtggctcggccctgcactctccaggaggcagaaagtaaagatgaaagtaccagctgaaagttcctttgctgtgggaactacgtcaaggttcctgagtcttgtgaaagctggtaactatctctggtgtgggcatgtacaccagcaggggtggcagtgtcctgttggcagtctcctcatttatcgtgaatttcaatatgctgtagttatggcataggcatgtgaaataatgatcaagcctatgggcagtaattttttttaccatttggggggctattttcctacaggttctcttaatagtccttgttttaaaagcccactgtgggcagggcatggtgcctcatgcctataatcccagaactttgggaggctgaagtgggaggatcacttgagcccaggaggtcaaaaccagcctgggcaacatagcaagacctcatctccaattctttaaaaaattaattaattaattaataaaatcccatcatgtctctctttgatacctgcctctttagggtgatggggtaggtggaaaacccaagtaatgtgattttgtaacatccactgctgcatttgtttgcggtgaagtaggagccttgatctgatcatacaccttgtggcaaatccaaatgctgtaaaagctgatgtgctaaccctgcaataacgtaaatagaggctgctaccttgcatgggtaagccaatagatgcctgtgtaggcatccaccactgttcaggcatatttcacggttccagccgctgcagggagatgcccaatggagttgaattgccagttttgatgtagcccttctcctctccaaatgtttcctcccacgaggtggtcccaatgtctggattgctgacacctggtacggtccctatgactttgtttaaatgtccctccactggatcaactcctctcttaacaacatattttcacaacctcatggtgcccaagtgccttgacctcatgtgtccatttgtagaaggggtcaggtggcttgtctccagggtctgaggactcgccctccttcgcagccctgcctgcttggctggttgggttagctcatcttcagcatggtatcgcacctcctacacatcttgtttaatgtgagcggaggtatggtacacaaccatgggcagagcagggtgaatctggcaatttccacccctgcccccgaccccatctctttatcccaaatgtctgggccttgtattttcagccttgattctgttaatgccccaactatgtagtcagcccattagcctctgacctggagtcagtgaaacaccttgggaaaatatttgccaagagcatggtctgttgctaggagtattgcacgcagctcagcctgcccgcactggggcccctccccgacaaggaaagtggactggtggactggggtgcagatgtcattgcctgactctcatattccccgtgttcgctccatctataaagaaagagcgttgtttttcttgttttgagagtgctggctttcctccctctggtcccccttgagtaaggggtggaattatttctaaggtttggcaagtttgcctcaccagcagggcatgtggcaatttgcccaagggcttgtggcactccaggagggccgagtttagccagagcctgtggagcccgtggagcccatttctattttgacctggggtcctctgctgcagattcggttttagggggagcttctcccactgtgcagggcatactaggaatctcggcgtgtagggtaatgggctgtgtcccaggaagggcttccgtttccagaagtacccagggtgctgccaggtgatgcctatcttgtgacggatacctttgggctgagactgggagccgcctacggcagaagcccatggataggtgctcgcctgtgcatttggggcagacactctgggaagcaaatttggaggcggctggaccttctcacttcgtgagtcctgccctcaggacaggtcggggagctgacataacagcctccatgcgtttatgtggtgtctgttgctcaggtccccgctagagagtggaagaggtaagggagactccacagatagcatccagcaaatattggaagtgggggatgtggtggcgccagaatccaaacatgccagccacagttgggcgtccttgccagtgtgggaggctgcagctctgggaacttgtcttttacaggatcggggacagtttgcccttctgagttctacacgtagccgccgaattcaacagaccggtaggggccatggaccttttggaggggcagttgcccatcccctcacagtgaggtacacactcagggctgtgaccacctgtgggacagcgccttagtccctttcagtgaggaggatgttgccaatgtgatggcaaagccgagttctgctgggagtgcaggcagcactcaggtcctgtgtgcaaagcctgtgtgcagtcgggggccagggagcgggtactgaacaaccccagaggcgaccagtataaggtgtcctgttggccccaaaaggggaaggcgattgtggtgagtctcctgggacattttcatggaacagaacatgtcagcagactcttcaactccaaactatttagccaggttgttttgaatgtcgtcttaaggcaaagatgtctggtagaagtgctctaagccaggggacagccttgtttaaggctccgtagtctggagttagcctcatacgttagtagtggctttcagcacagctcgtactggggagctggaaggtgagatggtaggagttccttccctttccctaaccaagtgagcgcagcaggacttgcctccgctgctatggggtgtgtggaaccccacactggcaggggaaggggcttggttaaccggctcccacctgtcagtggcagcaatagcacaggacccttaggccattctctgaggtcacccgctgactgagagggcccgttccagcgatgggaaaaggggcagattggggacaaccaccaagacagaaacgtcttttagcaaccctgggccaacctgaatagggaagagggtgatgatgctttcctggttcctcctcccaagcgggccacctcctggggagggccctttaaagcttgaatgttgcctgggatgagggagattccagcacctgtgttggcctgtggtgttgatttgctggagggcaaaccacagttaatgtggaaaaggctgattgtctgccagagggacctgcttccatgaccacgggatctgtgtggggcgggtccctgtcactggcagagatcaaggcaggtgttgaaggtgtggctgccttggaagcagaggcctgccatggctgtcccctcaccctggcttgtattgtgttgttgcactgatttatcagagcacatccaatttggatcctcttgtcccttagggctccatacaacccgggatggtgaattttacgtgtcaacttgcctgagccacagggtgcccagacattggatcaaactgttctgggtgtgactgtgagtgtgtttctgggtgagattaacctttccctggaagactgagtgaagctgaattccctcccggatgtggggggggcccacccagccagttgaaggcctgaggagagcatgagtcagaggggactccttctgcctgagtgctggggctgggacatcagtttattcccgccttggagcatgaactaaaacgtcagctcttccttggcctcaagtctgctggccatcacactggacctgcaccacccgctctgctgggttcccagcttgccaactacaggtcttgggacttgtgggcctctgggcccatgtgggccaattccttataataaatcccgcatatctccacatagacgtagacatatcgcctcctattggttctgttgctctgcagaaccctaatagatgacctcttccgtgcatctcagggttcccgctcaactgggggcctggctggtggtggtttatttgcactacgagggggcggccttgccggtgatgttccttgtgatttaggccaggtggggcattgttttcataactgcaggcaacactgggctgtgagtttgtcctccatgagattctattccatccagggcagccatggcctggtggattgtttagccttagccatcgctgacagaaatcaggacttgtacttgtcaggtgctccctgagaaactactgtgtgggctcagcactccactcagcctcctcagactacagagtcctcatgccgcgccatctgtcaccagataatcccactggaatgtacagagctgatggaggacatctttggcctcagctaatgttttccaccgccagtctgcccagggggttgtgaggcctcatgtagggtgggcagctatccaagccaccaaaactcacaaaaatgcaaaattcatactgaccaggtgtatatggactgcagtgcaaagcctcctgggggtcactcccagcttctgcactaactgtgcagaattctttagtagggaagccacttttctataccgtcctggggcagccaagtgcttcacttcagcccctgtcaggtggagcttgctttcctggttcttcctcccaagtgggccacctcctggggacggccctttaaagcttgaatgttgcctgggggagggagattccagcacccatgttggcccgtggtgttgatttgctggagggcaaaccacagttaatgtggtaaaggctgattgtctgccagaggggcctgttgcctctttcgaatacattctctgtagccaggcagccactttttcatttggttcctgggctaggttcttaaggacaggcagggcctccgtgtgagacagagggtgtgtcctcctccagataagagatggcctctccttcttgaccctcccctgttgtctcttctgtccttttgactttgcaggtgatcactggcaaaggagagggtcaagttcctcactctcccatggtagtattgtgctgccttatcctctagagggtgcaaatcctcttctccagggtcctctcctccttctggttgtccgtggaggttgggctcccacctcctctctgtgaggcatcctggtgagaagcagctgtgagcaagctcaacaggggtcccctggtttggattcaataggacagccacctcttttggagggcctggaggctctgggacttaaacttcctgcctttggtcactttaagcaatgctttatctggcttagcccaagggttggggtatcgatattcctctgcaaaggggctacgaagatgacattcacaaaagaataactgaatgtcacaacagctgtggcatgctaactgcttgtaaaggcatctcccccagctgtgcatatgggaatggcctcagcctggcatctctgcctgatcagctcatgtacctggcatagtggtccccaacagtaaggatgtcctcttgtctcagagtaccccaaatcactggcctggccacagggaactcctcccactctagcccgtcatggggtgaggttaggccaccttcagtccagagatgtgtactcctcccctttatgtgtgcgggtctataggccttatagtgttcagcacctgcctagtggggcttcaggcgggcaagctgacctccttccccaggcagtatcacacctctgacctcaaaagtcagttctaatgagatgaattcactcaaatactggcatgaccaggttaatgaagcacaggaagagaccacaaaaaaatagtgtaacacaggccaggtgcagtggctcatgcctgtaatcccaacattttgggaagccaaggcaggaggactgcttgagcccaggactttgagaccagccaaggcaacatagtgagaccctgtctctactaaaaataaaaataaatagccaggcgtaatggcacacgcctgtagtcccagctactcagcacgctgaggtgggaggattgcatgaggctaggattttgaggctgcagtgagctttgagtgcactgcactttgagtgcagtgatcatgttactgcactccagcccgggcaacaaagctagactctgtctcataaatataaaactaaataaataaataaataaatagaggcaggagaatagacacagtcagtccaagaccagcctagagagacttagagattatctctaaaattatcacaacattcttagagaatataacacagcacagagcaatgtcatgccaaactgatatggaggcattccagatttgagccccaactacttgaagccatccagtatcgatttgccaagtgatgatcctactgaccaattccctgatcactgccaaaaacccatccttatcaccccatgtagcaagtttgaagatttcagggctgatccaagaaaagacatgatcatgacatgtcagtattacaaaacaagctgtcatttgggtggcaccaggacacattgcacaagaggggaagttccctacagcaggagacctcctgagacagtggcatggggccactgcccaaaaagggaagagggcaatggaactcctggtggagaagggaattggagaaggcgttatgtgtcaaggtgatgtggctcagcagcaagatggggagtctgtgtcagagagctctgaggggcagcagcagcttggtgtcttttatagccccagaatttgttttatctatggcaggcagaggctaggtgcagttttgcagggtatgcaaagcagggaagttctgaatggctaaaaatattacttgggctatatttaaagcaattgatgtgtaagaatttgaatttggcaccagcctgctgtgaagaagtgaacaacagagtcaatatacagggaccatctttggttcatttatgtaacaacctttaattcttgcaatatgaggcagaggtcaagattattttttccaaggctattcagttgctccagcaccaaaagagtatctgttccccgttgaattttactgtggcctttgttgtagttcagccaataatctatgtgaagttctatttctagattgtttattctgatccatttatctatttgtctatccttgtcccagtacttgactgtcttatttaggcctttacattctttcaataatattttgtaattttctctaccgtgggttttgtacatattttgttaaattttttcctagtttttttttggtacatttcttgatgttctagtaagtagccttaaagtttcattttcttattgttgttcctgatatgtagaaatatagttgtatgtatacagttttatgtgttgacattttatccaatgatcctgataagttcacttataaattgtactagatcatctgaagatacttttaggcttttttacattcacaaaaatgtcatctgcatattatggcagttttatttcctccttcctatcctttacatttttaatttctttttcttgatgattgcattggctaggacctttaatacaatgctgagcagaaatggtaatagtaataacagatattctttccttgctcttaatctatggagaaactttcactcattcaccattaactatgatgtttgctgtaggttttatgtagatactctttgtcagattaggggagtttattgggggaaccaacccccaatatttcaacgtaggttcttttctattttccctaagtgtcggccgctctgaaaaataaagggaaacagtacaaaagagagaaattttaaagctgggtgtccgggggagctatcacatgtcggcagattccgtgatgtcccctgagctgtaaaaccagcaagttttttagcaattttcaaaggggagggagtgtatgagtagggtgagtcacagagatcacatgcttcaagggcaacaaaagatcacagggcagaaggtcagggcgagatcacaaggtcagggtggaactagaattactaatgaacttccatgtcccactgtgcacgcattgtcattgataaacatcttaacagggttcaagagcagagaaccggtctgactagaatttgccaggctggaatttcctaatcctagcaagcctaggggcactgcaggaggccagggcatgtttcatcccttatcttcaactgcataaggcagacacccaccccccccagagcggccattttagaggccccccccgggaatgtattattttcccagggctgttaattattaatattccttactggggaaagaattcagcaatatttctcttacccgtttttggcaataagagaaataatggctctgtcctgcctggctcccaggcagtcagacctaatgattatctcccttgttccctgaacatcgctgttaccctgttcttttttcaaggtgcccagatttcatattgttcaaacacacatgctttatgaacaatttgtgcagttaacgcaatcatcacaggtcctgaggtgacatacatcctcagtttaggaagatgacgggattaagagattaaagtaaagacaggcataggaaattataagattattgattggggaagtgataaatgtccatgaaatcttcacaatttatgttcttctgtcacgacttcagcaggtccctccattcggggtccctgacttcccgcaacacgagttcttatcgatttctagtttgtgcacatgtaccctaaaacttaaagtataataataataaaaaaaccatgaatggaaatgcctctcccaatcccttcattctggtgggtttataaatttttaaaaatacatattattttaagggcagtatatttgtgtctagggagagagaagactaaatgtttgtgaccaattcccccttttaattggaagacttagattgtttcttttttatttttaatctccttgtatgtgtaataatgttccctttctcattcctaatgtttcttttatcatttttcttaatcagatgtctttgacctattacttttaaaatctaccctagtgattttgttaatgaaacctaatattttgttctacgtgttaatgtctcattttatccttaattcctactttttccattatttggactaattttgctgtttttatattaaatgtttggttcatttctttctagattccacttataatgtatgcaatgggtgcatttttcaattcagtttttgccacattctgcatatttttatatttaatgtgtactcattgttgttcatttctaatatgttcatacttttatttttgatttttttctttaataaaataataatttggggggagactttttccatttctaattttatcacattgtgcctaaacaaagtgtctctatgatttgttgggattctctgagtcatctatgtttgtaaatgtttcctgtgtattcctcattggatttaaatatgtgtatgtatacccatatccatgtatcagacatagatcaagcttaataattgtgctattcaaatgagtcattattttttgtctgtttaagagatgtgtgataatttctgtctctgtaattgagggttcatcactgactttaaatctatgtcgttaggtacataaacatgccttaccaccatgtcttctgatgaatgttaccttttattattattaaaatatccttctttgtcccacttaatgtttttgttttcaaattttatgtccatttttcattttgttagcattttcctaattttttttgagacggggtcttgccctgtcacccaggctggagtgcagtgacacaatatcagctcattgcagcctcaacttcctgggctcaagcaattctcccacctcagccttccgagtagctgggactacaggcatgcaacatcatgcctggctgacttttatatttttttgtagagatggggtttcgccatgttgcccaggctggtctcgaacatctgagctcaagcaatctacctgcctcagcctcctaaagtgctgagattataggtgtggccaccatgcctggcctaactttttatttttaaagttatttttcaaaattatgaaatatttcaaacaaaccaaaaggtatagagaaaagtacttgggtagtgtgcagatcacatgtttgtgtcccctttccctgcccaattcatatgtcaaaacccttaatgttaaccttaatgggatggtattaggaagaggggcctttgggaagtagttaggattagatgaggtcacaagagtggaatccccatgatgaggttagtgtctgatatgatttagatgtctatccccttcaaatctcatgttgaaatgtgatccttgatgttggaggtagggcctagtgggaggtgtttgcatcatgggggcacatccctcatgagtggcttggtaccatgcttgtggtaatgattgagttctcactctatgagttcatgtgagatctggctgtttaaaagaggctggcatacagagtgatataatagactttagagactcagaagggggagagggaagaggggccaaggataaaaagaaactacacagtaggtacaatatttgctacttgggtgatgggtgcactaaaatctcagaattcaccactataaaattcattcatgtaacaaaaaaacacttgtaccccaaaagctattgaaataaaaaaataaaagagtctggcacctctcccctccctctctcttgctccctctctcaccatgtgacatgctggctcccctttaccttccattatgattgtaagcttccccaggacctcaccagaagcagatgctggcactattcttcatgtacagcctgcagaaccacaaaccaaataaacctcttttcttcataaattacttgagtctcaggtattcctttacagcaatgcaaaaatggactaacagaaaattggtattgagaagtggggcattgctataaagatacttgaaaatgtggaagcagctttggaaccgggtaacgggcagaggttggaagagtttggagggctcagaagaagacaggaagatgagggaaaacttggaactttaacgttagagactggttaaatgaatgtgaccaaaatgctgatagattgtgttgagtcttgacaacgaaaaaaaatgctgatagaaatggacagtgaaggccaggctgacgaagtctcagatggaaattaggaatttattgggagctggagcaaaggtcacccttgttatgctgtagcaaagaatttggctgcattgtgtccatgccctagggatttatggaaggttgaacttaagactgatgacctagagtatccagcagaagaaattttttttttgaatgtgattcttttattgtcaagagagtaaagaagacatattactggtttgtggataagaacaaataatatgctgcctagccgcccaactgtctgggaagtgaggggcgcctctgcccagctgcctaccgtctggcaaatgaggagcgcctctgtccagccgcccaactctctgggaagtgaggagtgcctctgcccagccacccaactgggaagtgaggagcgcctctgcctggccaccccgtctgggaagtgaggtgcccctctggctggctgcccaccatctggcaagtgaggagcgcctctgcccggctgccgccctgtctgggaagtgaggagcgcctctgcccagcctgccgccccgtctgggaagtgtggagcgcctctgcccagctgcccactgtctgggaagtgaggcgcgcctctgcccggctgctgtgcaaccttccaagtgtgaagtgacagccttgtgtgtgatcttttctgtcttccccaagtttgcattttcaacattaaagtttacttttcagttaaaagtaaaaaaaaaaaaaaaaaaaaagagcaaataatatgataatatgatcgaaggagatgacaaatattttctcagtcatatgtgatctttagttagttttttttttttttttgagacagagtctcactctgttgcccaggctggagtgcagtgacatgatcttggctcactgcaacctccacctcctccagaagaaatttctaagcagcaaagcattcaaaaagaggcatatggatagatatgggagcaaagaaatgacttaaaagttggaactcatatctaaaaa[131 bp omitted]gcaaaaccccgtctctactaaaaataccaaaattagccgggtgtggtggtgggtgcctgtaatcccagctatttgggaggctgaggcaggagaatcacttgaacctgggaggcagaggttgcagtgagccaagatcgcaccattgcactccagcctgggtgacagagcaagactccatctcaaaaacaaacaaacagacaacaacaaaaataaacttggaaaatttgcagcctggccatgtggtagagaaggaaagagcattttcaagagaggaatacaagtgggctttggagcacccgcttgctagagagattagcatgactgaaaaggagccaagtgccaatagccaagacaatgggggaaaggcctcaaaagcatttcagaaaccttcgggacagtccctctcatcacaagcccagagggctaggaggaaagaattgtttcatgggccagggccggggcaccaatgtcctgcaccacctcaggaggctgttcctcacatccccgctgctccagctctagccttggctcaaagggccccagacactgctcttgccaccattctagaaggcacaagccatagccttggtggcttctccatagtgttaagcctgtaggtgcacaaaatccaagaatggaggaggcttggcagcttccagccagatctcagaggatgtattggaaagcctgtatggccaggcagaagccttccacaaaggtagaactcccacagagagactctactagcgcagtgccaaggggaaatatggggctgtagcccccatgcagagtccccactgggacactgcctagtggagctgtaggaatggggccactgccccccagacccaagagtggtagaactaccagtggcttgcaccctgagcctgaaggcacttaactccaacctgtgagcgcagccaagccacagatgcagagttgcccaaggccttgggagcccacctgttgtacaaatgtgccctggatgcaggacatgaagtcaaagaaggttattttggagctttaaggtttaatgtctgtcttgctgggtttcggacttgtgtggagcctgttgccccctttttttggctgctttctctcttttgaaatggaaatgtttacccaatgcctgtaccaccattgtatcttggaagtaaataacttgtttttgatttttataggctaataggtggaaggacttacctcgtgtctcaaatgaaactttggacttctgagttaatgctggaatgagttaagactttgggggactattgggaagaacagttgtattttgcaatgtgagaaagacatgagatttggggggccaggggcagaatgatatggttaggatgtttgtcccctccaaatctcatatttaagtgtaatcccattgttggaaatgaggtctggtgggaggtgtttggatcatggaagtggatccctcatggatggcttggtgccattcttgcaataatgagtgagttcttgctctatgagttcatgcaagatctgattgttgaaaagggcctgatacctcctcctctctccctgtggcacactggcttccctttaccttccatcatgaggtcctcaccagaaacaggtgtgagcaccatgcttcatgtacagactacagaaccatgagccaaacctcttttctttataaactacccgagttgcaggtattcctttacaacaatgcaaaaacagactaatacagtgggcttataagagaaagagactagagctgtttctcttagccatgtgaggacacacgagatgatgccatctgcaaaccaggaaggtggccctcaacagacttcagatcagctggtgccttgatcttggaattcccagtccccagaactatgagcaatacatgtttgttgtttaagccacccaatctatagtattctgttacggcagcataagctgactaagacaggttctctctgcccagtgttgatagatctttatatattttttgccatatttgcttcagatatatacacacacacacatatatatatgcacatacatacatatatagatatacacacaccattatagataaatgcagttgaagctccctgtatacaacttccttctttcgcctcattctctccatagagttcatggctatcctgaatttggaggttcacttctccgtgtctgatattggtataaacatacctactttcttaggttagtctttgcgtaacatatcttttgccatctttgctctctacttttttgtgtactcataataaaggcatcctgctgtcctcagatgctggagatcaaggcagcactacagttataatgttaacagatgagccaatacctgagcccacacatgtatctcaagcccaaggattggtggcagaccctttataataagcccaaaacatatcctgttgagtgcagcatcctttgtgtgaacagagaagaaaaagaagttcccatatatcttttacttatcacccagggatggagccatcatgtgttgttgcaggattagtggcattggaggatgaggaatgaaggtagctttcaaagcctcagtctgcagtgggccatcatgtgttgatgcagggaccagtgacattggaggatgagactgaggacttcacctggcagcagtggcacttggacactgctcagaggactgtgtgtgcagacgtgatactggagaattacagtcagctggtgtctggggagggaaggtaatttggtatttacgattattgtgtctaggttgacccctttggcatgccattgacataccatgtctttcttaaaggaagtgggtctctggtggttacaggacatggatatgagctcctcagatgaaaggacatctccacgtctccccccattctttgcttagctttgagaaagaaccctgcttctcttccttgtcctcaggatctgatccctgcctccttcagctggagcaagcctttctaggtcatcctccctttctctaacccttttcactttccctccagccacttgtcatcaactccactccttatgcactcagacatttatagatctgtcctttttcaaatttgcgacttgtacttctacttccgtttctcattcttgtgaaaggctcaggtgttttctacttgtgttatacaaccagattccaccccaccccaaactcctcctttcaaggatctccattaggtggccctatcagttgtttctctctgttcccccaaactgaagttatggtgttgtattagtctactctcgcactgctacaaagaactgactgggtaatttataaagaaaagaggtttaattgactcacagttccacaggctgtacaagaagcatgtctgggaaagcctcaggaaacttacaatcatggcagagggcgaagaggaaagaggcacatcttatatggctggagcaggaggaatagagaacagggggaggtgctacacacttttaaacaaccagatctcatgagaattcactcactatcacaagaacagcaagggggaaatccactcccatgatccaatcacctcccaccaggtccctcctccaacactggggatcacaattcgacatgagatttgggtggggacataaattcaaaccatatcagctgtttttgttttctagttgtttgttgctgatgcaaagaaaaacaatttctatagtttgaacttatatttagcaattttgctaaattcacttattaattctaacaatttatctatagatgctttggatttttctatgtacacatcatctgcagaaattgaaagccttatttattcacttccagtcattactcattttctttttcttgtgttaatgcactgcctcagacctccagtacgatgttgattagaagtgagcataccaggtgtccttgtctcatttccaatctcaggaggaaattttttccatgttaccattaagttttgccatgcgtcttttaaacacacccttcatcaggctaaggaagttctcttctacttctagtttgctaagaatttatattgtgttgatttttctcaaatccctttctctttagagaaattaagattatataatttattattatgaatatatgaattcatatattcatatacatccaacacaatatcattaaattgtattattaattacattgacatttttaaatttattggcatatttttcataattccctgtccttttaatgtttatagaatctgtagtgatggacatttattatggacatttgaaaatttgtattttatttgttgatcagtctagagtttcttgcatatattaatctttttagagaactagctttgatttttgctattgtttgtcctctagaggtcatgaaaacaaatgtgaaggaggaaactcacaagaagtgctaagcatagatagtaagtaagctagacacttatgaaacatgaagaaaatgcacaggatgtgtgaagtatagataagtaaacaagtagcttttgagacaggcaaaattcataagatgtgttatagttagcaagcaagtaacttgtaagatgcactaaagataaatagaatacatagaatatgatagaacaaacaaggatattacttatagatagaaagggacaggaacaccaactcataaggtatcctaccaccttggttatattatacttaaattaaccaccaactggtgacacttagtattgttccactgaacacagataaaacccatcactgttcaggctaattggtaagctataagctgaggtaagcaaggtatgtcattgaccttgagcaccttcagtctgaatggggccctttttcaaacctcaactctggccctcataaccaataaggctgatggaacagagacagacagagacagaggcagggtctatgaatattgcataacacaggactcaggaaatgtagtccttcatcctgtttgtaccctctcctaagtctgtcaacttactccatctctttgcttcttcgtgtatatatatacacatatatatacatatatgtatgtatacgtatacatatctgtcctatatgtatatatgtatacatatgtatatacacgtgtatacgtatacatatgtatatacacgtgtatacgtatacatatgtatatacacgtgtgtatacgtatacatatgtatatacacgtgtgtatatgtatacatatgtatatacacgtgtatatgtatacatatgtatatgtatatatatgcatatacgtgtgtatatgtatacatatgcatatacatgtgtgtatatgtatacatatgcatatacatgtgtgtatatgtatacatatgcatatacatgtgtgtatatgtatacatatgcatatacatgtgtgtatatgtatacatatgcatatacgtgtgtatatgtatacatatgcatatacgtgtgtatatgtatacatatgcatatacgtgtgtgtatatgtatatacatgtgtgtatatgtatacatatgtatatacatgtgtgtatatatggatatgtatatatatttgcatttttcaaaaaaattgatttaataagccatgtgactcaaccattttatttcattttattttttttgaggcagaggctcactgtgtcacccaggctgggggcaatctcggctcactacaacctccacctcctgggttcaagcaattctcctgcctcagcctcctgagtagctgggactacaggcatgtgccaccacacctagctaacttttgtatttttagtagagacggggttttaccatgttggccaggctggtcttgagctcctgacctcaagcaatccacctgccttggcctcccaaagtgccaggattacaggcgtgagccactacatccggcctgactaaagcattttaatttggtctgtgagcctttctattctgagacttctagggtagcttgcctggtcgcatattgaagactatcattgtatcaagggaacttctcacattaacagaccccaaaggataaagtgagaagggatcataattcaaagtttggagtttacctaaagaaataggacaataatatgaaataattggctaaaatattgggggcccagtattgatctgggtggttatagggtcaatcaagggacacagggctgatcttaggaatccaggatagtttcgggagccctaagaacaaggtgaagaaggaccataattaattttattttagacattttagctaaagcagtaagacaaattaagtaactggcataaatagatgtgggggtgggagttagggctggccaagggggcacaacagagctgatttgggggcggtgtcagggacacctcttgcagtgggccctctccccctctgagtatatataagtaacaatggcaaggagattgtattagtctgttctcatactgctaaaatacctgagactgggtaatttataaagaaaaaaggttaagttggcttactgttctgcaggctgtacaggaagcatggaagcatctgcttccagggaggcctgagggagcttttactcatggcagaaggcaaagagggaacaggcatcttacatggcaggagcaggaggaagaaaggaagaaggtgctacacacgtttacacgaccagatctcaccagaagtcactaactatatggtaccaaggcgggatggtgctaaaccatacatgagaactccacccccaagatccaatcacctcccatcagacccctcctccaacacgggattacaattcaacatgagatttggatggggacacagatccaaaccacatcaggaatggaacacagaagtgacattcattgagcactgtctagaacacaggctgatcccatcccatacacctgtggtcactacagggtcttcagcgcagctcctctttgtgcagaaaccccagggatcacctcccacctccacccaactccccatcaccaccaacgcaaggtcatgcatcactgagaccccaagaacctataacctctgacaccacagatccccatcactcacctcacagagtgcctcccattccagcacagtcttcccaccttgactgcccggcattcttcccctcttcattcattagcgtcatgccatgctttgccactttcctgcactgctcttcacccaaccccattaaccactgtcattcacactgtgcctcatatcactcccaatttcctccactctgcacccactcactgccagtctactccctccttctctccccaacactactcatgtttacttacactcaactgtttcttctccagtaactcacaacactggatatttcccccatttcgccctactcttccctgttcaccacccttctgcccctctttactccattcactccccacttagcccttcattgccctcctctctcttcctccaatcccaatccttttattcacatgctgatgttcatctccatccattcccctgtctgtgcttcactcacctccattcacccacatgtgggccatcagcttgccatttgtgtcccaggaagcaggagtccaagatctacctgaaatggtgagatctgaccctcacccccaccccactataggatggccttcaatggacctgaaaccctagcaagattctctataagtagaaaggaaaaatagctttatttccagtgcccttgggcatctttcaaggagactgcaccaggagcaagccagtctgccccacgtttcctctccctggaaaggcactgaatgtgataggtttaccttaaatagttcataaagtgagcccacggcttgtttccttgcaggattactcagggtaaaaagaaggcccgaaagggcacaggcagggtctcaggtctaactcacccacccattttgataaatccaaacattgcccatccctagtttttcacagcttaagttgtccagttccagcaaagagatggccccagtgaaaagccacagaagcatgagggccacaaatacagtaattcacaagcaggacctctcgttctgaagcaaatgtcctgttatgtgggctttgactatgtccattcagaccatcactctcaatctgtctatcaccttggaaaatatgtatcgccagcactagagcaaccttagagaagcaagttattcaacctctctatggattcgtgttttgcagcacttgtaaaaagcgtttgtatgaatgatgtaataaaaataatttcgttaagatatggaaagtcctcggtgggctttagtacaggatcttttcacagatgtcactatgcatgttccagtctcaattattttagttacctaatgtggtcccagctgaccggagaatcacttcatttggcaacctcaggaaaataatgcctatgtgcctctggaattgattgaataactgttgttctatctgcttggttcttcaatttattcaccaaaaataaactctacattgagcatatctatattaaatgttataaaatcctgtacctagactgtgactttactataacagtaaaacaaaatagctttttaaatgttttatttttgaaaaggtagtacatccacatagtacatagtacacccacattttcaaaagctatgaaaggatacagttgtctccctctcaattccatccccccagccaccactgccccttcccctcccaaggtaatcagggttaccaggttctcatgtctctttccagagataacttatgaattcacaattatgtacttaccatttttctcctttttatatacaaatggcagtcactgtcctcaaccttatttttcctacctaataacataaactgaaggttatcccacatcactacataaatggtttccaagttctccttatttattcattgttgtctacccaggagtaggctgtatgaatataccacaatttagggaaccagaaccctgatatggtgtcatttaaacagcttccaatcttttgttttcacaaacgctgcattaatgaatactgtatgttcatcattttgtacatgtgtgagtatgtacattcctagaagtggaattgctggcccaaaaaccaaatgcatttgtggttttgattacttttgaataattcctctttgaatgagaagagtttttcctggacttgctatttgctggaggttcatgtgggaaaagaaaccagggccacattctaagcagatcagttttttttttttttgacaactgagaattttttccccccacagctgttcgttctttctgactttacttctcccaagtcagtaaataggggcagctgtagggctcttcacaaggaaaagtcccttctcttcccccagcatgccataactgttgctcccatcagtagactactttctaaaaatatggcttgtctgagtgactccttctcgaggccccagcctgtttctcctcagaccccaaatggtctaggaaacatcctacctcctacctgcccacgcactgttaccactgttatatctatggttccgcgcctcggggtatatcccgaacctcagctaagagtccttaccagtgctgtcttgcacctgcagccttgagcactctcactctgaaatctcctgcaccagtgcttcatttcctctgcctgtggcagccctctcattagggttgcagctgtctcctaattttgtcagatacagagattacacttctgctttttctcccgtagcttttgggttatgactgagatgaaaagaagaaaggctgaatttactcccatatttaaaccacaagtcaaaatatacttttaaaatgtgagtaaaattgacacaactttctttcagtgtccataatagatactgctgattagctctctaatgtgccatgaactttgacttccgagtgtggcctcttccatgggctttctttcctgcatgggttcgctgatgtacaataaggtttgatttttgggtaaaggctttcccacattctgtacatttatagggtttctctccagtatgagttctttgatgtacagtgaatgttgacttttctcggaaggctttgccacactcagtgcatgcatagggtttctctcccgtgtgcgttctctgatgtattatgagctgtgacttctggctaaaagctttccaacacacaggacattcataaggtttctctcctgtatgaattctctgatgtataatgagctttgacttttctctgaaggctttgccacattcattacatttatagggtttttcttctgtatgagttctttgatgtataatgagatatgatttctgtgaaaatgctttttcacattcattgcactcgtaaggtttctctcctgtatgacctctctgatgcagcatgaggtaggacttctgagagaaggctttctcacattcattacattcaaagggtttctctcctgaatgagttctctgatgtacaccaaggtttgacttttgcgtgaaggtttttccacacacatcacattcatagggtttctctcctgtatgagttctttgatgcacaatgagggttgacttctcattgaaagacttcccacattcagtacatttatgaggtttctctcccgtatgagttctctggtgtataatgagagttgacttatcactgaaagttttcttacactcattacattcatggggtttctttcctgtatgggtactatgatgtataattagatcaagcttctgtatgaaagattctccacatttagtgcattcataggttttctctccagtgtgggttttctgatggacaatgaggttggacttctgagtgaaggcttttccacattcattacattcataaggtttttctcctgtgtgagtcctgtaatgtatgatgacagttgacttttctctgaaggcttttccacattcaggacactcaaagggtctctctcctgtatgagttcgcaagtgtataatgagctgagatttttggctaaaagcttttccacattcggtacatccaaaaggtttctctcccgtatgagttctccaatgtacaatgaggtgtgacttcttgctgaaggttttcctacatgcagtacattcaaagggtttctctccatttttaattctctgatgtagactaaggcctttctttcgcctaagacctttcccacactctttatagccatagggcttcattccaggatttgttttctcatactcagtatggaagaacaattttgcacatccattatcatatttattttctgcagaacttctactaaataagtctaaattatctaccatattatttccaaatgattcgtgtttatcgggtctttgtattgaagcaacaaggtttgtactcagatgaagtatgtttccaaactcatgacagtcacgagcactcttggtgataattgttttcttgtcagaaaatccaacttgcatcagcagacatttatcttggtcatcctgatgttgcctctcaatctgttcatcaacttgacagacttctagaaagaagtacaataaaccacctttatgctttgacattatggagcggaccttctttagaattattctgccatatgaaagctgatactataatctcattttatcagagttcctggagagagagttttttactaaactctcacctgctggtctttttgttaccaagaacaatcttaccctgacacctcagtctttcttacgtctatttatacatcatacctgacttctatcaactctgcgaaacttatacccttgatcttcagttatcatataaactttttttttaagagacaggatctcagctctgttgccaggctggagtttaggggcaaaatcacagcttactgcagccttgacctcctgagctcaagcgatcctcccacctcagcctcctgagtagctgggactgcaagcgcgagccaccacatctggctaatttttgtatttttttgtagagacaaggtctcactatgttgcccaggctggtctcaaactcctggtctcaagcaatcctcctgcctcagcctcccaaagtgctgggattacaagtgtgagccatcacacctggccagtatcatatgaagtcttaactgtacctgacttacagaatttctgtctaggtggaaatgcaacagcatgattcccagactcatgtgttacaacagttaacactgaatccacattctcaatgaatgaaagaaaaatacagaatggttagcttgacaaaaacaaaaagctaaaaatatttgcccagtctgggttcacccgtgtatccatcaaagcttgcattcacagttcttcaacactaccttctctgctcctgcctatacgatttccactaaaacctctgcctattctgtactccaaacccttcttcatgttccatcacccacatagccctgtgttccatattttgctatattcagaatctagataactttcaagaggcaggtcagtcttttctaaaaagcttactctgatcttcctatataacttaaatttttattaacttctaaagtagtcagtcatctgtatcactcatttaaacagttaaaattgcaaagctttgcctttaatttcatcaattgcaagcagcacattatttcacattttaacatctctgaatccagatgcatcttacaatcaatgtcataggttaactggtggcaatttttctttcttagtggtatgtctttaaatctatggcatcttgaagttaataagatatggcaagtactttttgtacatatggtgaattttaaatctttttttatagtttacttttcttcttacttttccccaaatttttacatgaaaattttcaagcatagaaaaagttgaaagaagagtacagtaactactcatattaccacttagattcaatagtgttaacattttgctatagtgatactgaattttaacatggattgtgcagctgtggtttttcttcctgtgacttcctttctttggctagctaagcattagttcttaaccagagatgaacacaaaatcacatgaggaactttttacaaaatgctctccatgggacccaagctccaccaaagatctgctgaatctgaaccttcttaggtggtaagaagcagtttggcccatgtggttagggtcctgggctctctagcccaggagaaaatcctggctcaacctttcacttggtctatgacctcaggcaagtgatctaaactatttgtatcttacttctccacccataaaggaattataacagtgcccacccaaacggatgttgagagaattaaattacttacaacagggcttgcagggtacacaggaagtactttaaatcatttaccaccactactactattacaactactactattatgacttttaagaatcaccacattactgtaaaaagaaagagtatatttatatatttaacatgttctagaatattaagtgaaaaatggtgaataaaactgtgcatacactgttacctgaggcaggaaacaaagggaaaaactgggtgatgctggaggttattttgagccataggagagggaagctgaagggtttttaaagtgtgtgtggggtgtgtgtgtgtgtgtgtgtgtgtgtgtgtgtgtgtgtgttatggtataagtttcatcactttgcttcttttatagcaaggaatgagatgagatcatttgctaaaagagagggaaaaacaacttggagtggaggtttgaaggaagcaagaaaggtgttataagacatggaatcaaacctaagtgtccatcaaggaatatcaacggataaagaaaatgtcatctatttacacaatggaatactgttcagccataaaaaggaattaaatactgtcatttgcagctacatggataagcctggaggacattatgttaagtgaaataagccaggcacagaaagacaaatactgcatgatctcactcatatatgggagctaaaggagttactctcatagaagtagagagtagaatagtgaccagacactgggaggtgaagaggggaggagaggatagggaaaggttggtaaatgggtgcaaagatatagttagataggaggaataagtttccgtgttacattgcacagcagggtgtctatagttaacaatatagtgtatctttcaaaatagctaaaagaaaagattttgaatgttctccccacaaagaaacaaatatttgatgtgatgaatatactaattaccctaatttgatcatgacacactgtatatatgtatcaaaacatcacaccatactccataaatatgtacaattatgtgtcaactaaaagtaaaactttttaaaatgtttaaaaaactgtgcatagtaggaaatgaataaatatatattcttataggctcatgttgtaaaaagtgatggaagaataaacctttaaattttaataaaggttacctatgaggaaggaaggaacgaagggaatggaatggaaagggaaagaagctggacttttctgaatataccttgttttctgtgttggactttggaaccaataaatcttttgtaactattttatataatcataaagcaaaactgaacataaaaggattccttaaaaatagtaaatattctttctgctgcgtttcctaatgaccatgctggaaagtcttgattctcaatggcaccaaaatgattacctcaattcattcaactcgctatacacaagcaacagcctcaagaagagtactaacaatactactgtcagatgtaagattcataaattaaaaacctttaagcgcaaaatttgatttggaaatattaatttgaacatgagatattttttctgtaaaaaatgtatacataatagttcctagctttgtcaatgaaaaggcctcaaaacaattctctaacctctaaatcgtgggcttaaaacattattttccactaaaaagaaccagagccccttgaagaaatcaccaattctaggtcagaggaaggaaatatacaaaaggagcctgggacatgttgtaacaccagaaagcaaggaagctaccaaagactcaggagccaacttgaaggagattccactggccaaagatgggacagtgtcatgtgtaacatggaaaataagacaatggattaaaacatagaaatgtatacagccataagtccataaatgagtcacaaaaagatataacttagtggtcacctttggatgatgctacaaaatcaattattttgaaaactagtaaataaatggaaaagctcaatcactgagcctgtcttttctgtacaatatgtaactcatggtagccaaataa[139 bp omitted]ggtgaaaccccatctctactaaaaatacaaaaatgtagctgggtgtggtgacatgcacctgtagtcccagctactcgggaggctgaggcaggaaaattgcttgaacccaggaggcagaagttgcagtgagccaagatcacaccactgcactccagcctgggcaacagagcaagactctgtctcaaaaaaaaaaaaaaaagttaaacatacagttccttttataccaccacatggtataattccaatcctatgtatctacccaaaagaaacaaaacatatatcaccacaaaaaatgtgtacatcaatgttcacagcaccattatccataataaccaaaaggttgaaacaagcaaaatttccatcaattgatgaatggacaaacaaaatgtgttctatcctaacaatggaattttattcctccataaaaaggaatgaagtactgatacatggtacgatgcggatgaaccttgaaaacatgccaagtgaaagaaaccagacataaaaggccacattttgtctgactctatttaaataaaatgtccagaacaggcaaaaccatagagacaaaatagatcagtggttgccagggagtgaggggaagagggatgagaatgactgctagggagtaggggcttcttttcagtgtgatgaacacgttctagaattaggtagtggtgatggttgtacaactctgtgaatatactaaaaactactgaattctgtacttcaaaagggtgaattttatgatatgtgaattatatctcaataaagctacttttaaaaaatagataagatgttttaggagagcaaatctgacaaatatctaaactgaatgagaagactggactcaggttgttcaatctgaaattagagcattagagtccaggcctgtgactaacgtgggcctggctttatataagtcggtgacaggtgagagtcgtgaaagtggcaaggccagggggttgtggcatttaaaagactctttcatacgggacaaaaggaactgtgcagaaacttgcaggtaagcaccaacttaaggagagtggcctggtgtatgggggacagcgggagtgtcagttttgtgtctgaggtgttcatgtccctgtcctccaacagtgccaagggccagaaccttttcctaagatattcctgaaagccctgtcagagggcctcacctctgactaatagggtggaacttcatgtccccagagcctgggtcaaaattccacttacctggaaagttccaaaatgggatttttccttctgccgggcattcttctacctccaacttgaggatgaggtttggtttggtaacctgctgccctgttgatgagaaatgacagtgatacctccttggctttcagagcctctgagacagaagaagttacatattgggggcagcacaaggaatctattgcttgacataatggtaaagtcaaaccatttaacctgcattttgagctcacaaacactttttcaggagagaaaagagggaactgagaaaggaaatgccttccattggatgcaataatcataaactgcaaaattacctaaggaagctattcttacccacaaagaccaagttgctgtaggtctccagcatcacgtctctgtacagggtcctctgtggtgggttcaggtactgccactcctcctgggtgaaatccacagctacatcttcaaatgtcactagcccctgtaatggtacattccttttattttaaaatgctgaccactagatgatgaggataaaatgcacgggaacttctgattgggttcctggttcatcatgatgactcaatattggatgcctatttcatatcaagttagtgatctactttgtgggagaatcacaaatcatggttaaaaaaaaactaagtaagagaatacttgagacaatgtcattatcagcacaaggacagacaaacagtccagtggaactaaaaagagaatccaaacatgtatggacacctgatttatgacaaagttggcacagtaaagcagtagggagaagatgaccttttcaatagatgtggatgggttattagatatctatatggagaaaatgaaatttaacccctctagccacacataaaaatcagctacaggtaaatcgtaaatctaatgtgagaggtaaccaattaagtgtctataaaataatacaggaaaatgttttcataagctttggagtagggaaacaattctataacaaaacatgaaaagcactcctcataaaggaaaagacaagtgttataagatcaaaagtactacaatgaaaaggcaagccacagatggggaaattgctggcaatattcatgagggataaggtatcgtatgtagaatatataaaataatcccctcaaatcaataagaaacacacacaaaagaatggataagagaagtgaataggtacttcactgaaaagcaaaaccaaatgatctatgaacacaagataatgtactcaaccccattagcaatcaggtaagtgaaaaattaagccacattgagacaccactatacacccacaagaaaggttataattaaacagactaaaataacataatattgtgttgaaatgagaactcttacacactattagcaggaatataaactggtataatcgctttggtaacagtttggcattatttacaaaggttaatggtttgcatataccatgacccagcaattctactcctaggtacacatcttagagaaaatcaggcatatgtgctctagaaaacaaatataaggatgttcatagcagcactatttctaatactagatcacagataaaatccaaatgtccatcaacagtagaatgggtaaattgtggcacaatcattcaatggaatgctgtatagtaatgaaaatgaatgaactgcatgttgtgaagcaggttcacctgcttcgaaactcgaagattgaagaaactctttttaaccttgggttagacaaatatttcttagatgtgacaccaaaattcaaaaatcacttgttaagagattaaaaagacacagaatggaagaaaatatctgcaaatcaaatatctggcaaataacttttattgagaatatataaaaaaaactttcaaaattaaaacaaagtgggcaaaagagatacttcaccatgggagataaacagatggcaaataagcacataaaaagatgctcaacatcattaggcatgagggaactgtaaattaaaaccacaatgagatactactacacacctattagaatggggaaaaaactgacaatactaagtgttggtgaggatgtagagcaactgcacctctcctgtcataagcaggaatgaatatgtatgtatatctaccttacaaccctgcaatcccactcccacgtttatttacctcagtgaaatgcaaacttaggtaaacctaaaagcctgtacatgaacatttatatagcaactacatttttaatgatcaaaacctagaaacatatcaaaggttttccaaccagtgaatggataacaacctggaatcctccatacaatgtaataccacttggcaataaaaatgagagaactaatgatttatgcaacgacatggatgaacttcaaatgtattatgctaagtgaaagaagccagactcaaaaggctgcatactgcatgattacatttatatattacatttatggtaaataaaaactacaaagactgaaaatatatctatattttccttgtcaacaatactacttccctggtcagcaatactgtgcatattgtcacatctcaatgtgctgggagggtgacatgaaagtgaacaacagaagcttcatggctgggaccctctgagaccttaccctatgcatcactccctttggttggttctacttgtatctttttgctataacaaaactgtaatcataagcatgtacttttctgagttatatgagtcattctaccaaattattaaacctgagtgtataccgagaacccttaagttgaatcaaggtgtggaagtggaagtggcaccattcaccatcacccctagtgacccactagcaaaatttttgcttcctgttcctgcaacattatgttctgccagcctagagatcttagttccagagggaggaatgctgccaccaggagacacaacaatgattccattaaactggaagttaagactgccacctggctactttgggctcctcctacctgtaagtcaacaggctacaaagagagttatagtgttggctggggtgactgacccacactatcaagatgaaatcagtctaatactccacaacggaggtaaagaagagtatgtgtggaatacaggagatcccttagggcatctcttagtattaccatgccctgtgattaaggtcaatgggaaactacaccaacccaatccaggcaggattacaaatggcccagactcttcaggaatgaaggtttgggtcactctactgggtaaaacaccacaatccattgaggtatttgctgaaggcaaggggaatacagaatggatagtagaagaaggaagttatcaatatcagctatgaccacatgagcagttgcagaaacgaggactgtaattgtcatgaggatttcctccttattttgttaaaaatatgtctgtgcatgtttacacctgtattaagaaaatatcttcatgttatttcctttttcctttatcatgtgacataagatttattgacttcatatcagcacttaagtgttgttaactttatgtaacagcaattaggctaagaattagtgtgcttccagttgtacgagggatagctgtattatgttaggcataattacgaccttattattgtctttacttgaagatttatgtgtgatttcaggagatgtgtacagttttaagttgataaggggtagacttataatggttaatattgagtgtcaacttgattggattgaaggatgcaaagtattgttcctgggtgtgtctgtgagggtgttgccagaggaaattaacatttgagtcaatggaatgggaaaggcagacccaccctcagtctgggtgggtaccatctaatcagctgccagggcagctagaataaagcgggcagaagaaggtaggaggagctggctttctgagcttccggccttcatctttctcccatactggatgcttcctgtcctcaaacattagactccaagttcttcagcttttggacttttagacgtataccagtggtttgccagggcctttggccacagaatgaaaactgcactgttggcttccttatttttgaggttttgggactcagactggcttccttgctcctcagcttgcagaaaacctactgtgggacttcaccttgtgatcgtgtgagtcaatactccttaataaaatccccctcatatattcatctatcctatcagttctgtccctctagagaaccttgactaatacagaagtcattgcaacttaatatacataatgattataaaataaaacaacatgtcagagtttagaccaaacataccagccaaatcaattaatgttattaggccttaagaaggcttattaaaagaagatctccagattgactcacaagcaagatccagctgtatgttgtatacaggaaatacaactaaaacaaagtgattcgagaaggctaaaagtaaagggataggcaatggtcgaccagacaaataaatggaaacaataagaaagcagaggttgagatcctgacattatccttagtctaaagataaaaggcataaaaacaaattgtgtattatattcagtaggttggttttccacagtgatgtgggtgcagcaattctgactctactttctgtatattgtagactgaacaaatgaatgaattattgatgctaggaaccaatgctctcactgttaaagaagggagatgcaaatatgcaacgagggatgactaagattcccaggatgctgtatgaactcaaagtatgtttgtatgtgtgtgtggtgtatgtgtgtacacatatagatgtagacatacagatgtagatatatatgtacatacacacatctctgttcaccgaaagggcctagaagtaacaatgccccagcagcaatgagcacagctagcacccagattttggtttctaaatataattatccattaacaggaaccagagctccttggagaaatggctgattccagggcaagtaaagttaaagatgaaggctggaacatcttgtgccagaaaataagaaaacgctcagagctcagaaatggaccaaacctaccaaagccttaaaattccactttcaggactgatatagtttggctat[132 bp omitted]catggtgaaaccccatctctactaaaaatacaaaaattagctggcagtggtggtgcatgcctgtaatcccagctactcaggaggctgaggtatgagaatcgcttgaactcaggaagcggaggttgcagtgagctgagatcacgccactgcactccagcctgggcaacagagtgagagactgcctcaaaaaaaaaaatatgatccccagtgttaaagggagggcatggtgggaggtgcttgggtaatggggatggatccctcatgaatggcttggtgccattcctttggtgatgagtgacttttcactctatttgttcagacgagatccggttgttaaagagtctggtgcctccctcccccactcttgctcccactcttgccatgtgacatacctgttccctctttgccttctgccatgagtagaagcttcctgagtcctcaccagatgcagatgctggtgtcatgcttcttgtacagcttgcaggactgtgagccaaataaaccacttttctttataactttttttttctaaagaaaatgttcagaaaattatagggatgtctcaaaacgacacaaaagccagcttaaagggactctcactggccaactcagggacaactgagcatcgaaataaataatgacagtaatattcactgactaaaataaaaacccataaaaataaaaattttctataccagattataaataaataaaggagataaagaaggtctgcctcatagtaaaatgacaataaatacagaagaaataataagagttagaaaattgtcatttggcacccatcacaataactgattcaggcaagattaatcaatggataataatactaattggtgaaaagtttgatgaagaatgggacaattatgtaacctcaaagtatcatccacaaattagttattaattacaaaggaaaaatagtaatgttacagcacagaaacgtggttagtgagagaaacaagtgatcaaagttaatatcataaaaaatgagacaaattgggctgggtgtggtggctcacacctgtaatcccagcactttgggagactgagatgggcagatcacttgaggccaggagttcaagaccagcctggccaacatagtgaaaccccatctctactaaaatacaaaaattagccaggcgcagtggctcacacctgtaatcccagttacttgggaggctaaggcacaagaatctcctgaatgtgggaggtggaggttgcagtgagctgagatggcgccacagcactccagcctaggcaacagagtgagacttcgtctcaaaaaaaaaaaaaaaagacaaattgacatcatatgcccctgatgtgatacaaggatacatcacttacatttttttcctaccagaaatgcatgacctcaatcaaaccatgaggaatctaaagtgagggacgttctacaatacggatggcctatgtgctttaaaaatgtcacagacatgaaaaacaaagaaatgctgaggaagtcttccagattaaaatataaagaatatacactgcataatagtattatatcaatgttaactttctgagtgtgttcagtgtaatttaatgatataggagaatgtccttgctcttaagaaattgaggaggccagctcctggctaaaactctatgtgtgatttttaattattaaggcctgaccaatgacaattacaaagacttcagctgtcaggctttgtaggagaaatctgcccccacatcagacttggaatatatagccagaacgttataatctctaaagagactggccagccccactcttacaaatatctgtattcctaggccaggcaccttcactggagaatgatgatcattaattcaaatttctaggtttgttcatgccattcctgctgattattgagccagagtagccttcatcaggaggtcaggtcaactagtccacaacaaaatccaaatcatagctgacaaattctcaggcattaaaaaaaacagcaactgacaaaataataaaaattaatcaccaacatctacaaatatatttttgttgatatctacaatatcaataaaaatacaaatcaggcaccctcccctaaataatatgggcaagagccttcctccaaaaatccgcgtctggttactcaataacggggtctctaagagactgacgggcttctcactaaaaaattaatggacaggtactgggctacacagggctcaacatacagcctcattagggtctgcacagtgatgactaacataaagactatctgaagtgggtagcaggagtaagctgtcattatgctattgtgtctgccattaactctcaaactgtcacccccaaaataaatgcatacatatgtgtgtatgcagacacacacatacacatatacatacagaaataaagtaaaaataaatgtgggaaaaggtcaaaaattggtgaatctagatgaaagctatataatcattcattgaactattctcgcagcttctctataggaagtggctagcacatgtgtaaatttggtcaacctcattaataaataaatgaaaatgagcaatcatccatcaattatatgattggcaaggtataaaaacactgataatatatgcttgtggggacaatattcagaaacaagcattctgttgcactcttggtgacagcatgaccttgttaagcctttttagaagagaatttggcaagtcctgttaaaaattaaaacaatttcttcatttcagaaattccagttataggaatctgtcctacagaaatgtctccacaagaatacagacatgcacattcattcccttcctaactctctgtgataaaacaaaagtggaagcaccccaaaattctatcaataagggaacaaataaaagaaaaatgatggtttatgcttgaattataattgttatgggttgaattatgtccccccaaaattcgtatgttgaaatcctaacccccaatgtgactatatgtagagggagagtctttaaggaggtaattaaggttaaataaggccataagggtaggttcctcatccaagaggactggtgtccttataagaagagaaaaagacaccagaggtccctctctctctctctgcacccaaagaagataggccatgtgaggccacagcgagaagacagccctcagcaagccaggaagagcagcctcaccagaagccaaccctactggtgccttgatcctggacttccagcctccacagctgtgagaacacagatttctgttgtttaaaccacccaatctctggtattttgtaatggcagcctgaaatgactaatacaataatcttccgcaactgttaagaaggaaaaggtgaccacactttggttactcatttgatgagtatttgttaaattaccacactgagtgaaaaccacgaggtggcaaactatacttacaagccttccttgttccatataaatggatattagatagaaatggtagacttctagtcctgacatgatggcacagactcctctttccctgctcttccccactaagtacaactataaaccctgaaagtgatgcaagagacaaccaaaagaggactctgaaaggaggaaagtggaaagcacacaggttagggacccaaggacttaaacagtggcaggacatcttatgatccccccaccccaacaacggaaggcaacccaggcctgtgtctctaaacccccaacctagcaacagaacacagcctaggtagtctctgtcttcccccaaatcagcaggagtccttccaacaacaccagacaagcctgtgacaccagcaaaggagattaatctggagccttgctgacaataagcagccaccggaagtgcttcttcttctccactgagcctgagacttccttcccctatctagacactccctctccacttcaagacacctggcagtcaggtaggacggcagggggatccccacacaacaagcacccagccaggaaatgttcttcatccctgctggccaaaaaattggctctctcacccaaagaacagacaccatgcagatgcagcaggggaaaatctggacacaacaggcacccagccaaggaagcactgtttgtcccctgtgtagtgaattcctggaattttatgttgctttagcatccactttgaatataagttggactttctcaaacaagaagcaggactcagtcacctttgacacagtctccagtcctccatctcctccctgttcctaaatgtggtcgactcagatatcagccttatataaccacctactggtgaccacctccctaggggacagctagacacaacccacttgactcgcccctctgatccccacaccccacatggactgcacagatatgccacactgaccaccttccagtcacagcgtgactccatggaacttgcacctgcttgctccaaacccatcagttaaaactctccatgaaaaggcttcaccccacaggtctgtccccccgtgcccctctctgtccccactcgctggctgagcacatgtgtcatggtcagctctctgtgtcccgttggccctgtgaggtgtgctgccctcttccgtctggacctgtgaggaatgtgctacctccgtgactttctgtgttctgttgagttgcctcctctgtgtctcacctgccccacacacccaaacctaacttctctcccagtcagggctctcctagagagtggctatcttggtaggaataagcttgacccagatcagacaagagccacaagggtgtctgccagaataaacaggtttcctgggagagggacacctggtcatgggtcagacacaggcactaagctgctcaccagaataaagaagaattctctgaaaggcacatttgtaaacacccacaaccacattccctggtgccccaccaggatggggttagaatttaaagccaagcacattattagaaggttagaactttcaggcccacccccagacctctagggagggaacaggggctacagactgagttaatcaccaatgcccaatgatttaatcaatcatgcccatgttatggaactgccatagaaacctctcaatggcagggttagggagcttctggttcagtgaacacactgtgttgggagggcggcacacccagagagggcacagaaggaaaccctgtaccctcccatgccttgctctgtagaactcttccatttgactgttcctgagttgtatccaccataataaactaataatcataagtgctttcctgagttctgtgagttgttctaacaaattactgaacctgaagggtacatgagaatctctgaatttgtagtcaaccaggcagaaacacaggtagcctgggcaccccactcgtggctggcatctgaagtggaggtagtcttgtgggaatgagcccttaacttggaggttctgcactaattctagtacctatgtaggaatttgaggaggacacaattcagcccagtaacaatttacaaagatttaaagcagccaacacaaaaatgctcccatgattacaagttcttctgagataaaaacaaaatctcagcaaagaaacagaagttataaaacagagaacaaaatggagattatagaaccaaaaaatacaacaagcaaataaaaactcactgaatgagatcaatagtttagtggtgatgacaaaggacagaattagtgaacctgagaaaagatcaatagaatttactcaatctgaaaaacaagaaaaagaaaactgaaaaaaaaaatgaacagaatctcagggatacatgggactataacagaagatccaaattcatatcattgccattccagaaggagatgaggagaaacagaaggtggtaacaagagtatttgaagaaataatacctgaaaacttcccaaatttggcaaaagacataaacctacagattcaagaagctgaccaaatccctaattcatgccaagccatggcaaaattaagcttctgaaaactacagaaacagaaaaaattttgaaagcaaccagagaaaaacaatgcattacctataggtaaaaaatcaaaacaaaaaataaacaacaacaacaaaaaaacaatttgaatgatagcagatttctcaacaaaaaccatggaggctagaaaaaagtagcataatatttttcaggtgctaacaaaaagggactgtctaccaccaattctatatctggcaaagttatccttcaggaatgaaggggaaattaagacatttcaggtgaaggaaaactgaaagaatttgtctctggcagacctactcttaagaaaatgcctaaaggaagttcttctaacacaagggaagtgataaaagaatgaatctcaaagcaccaagaaagaaccaggaacaacagagaggaaaaatgaccaattcgatataaatacatagggaggagaaagggaatcagaggaaggggtggaaagagaaagaatgagagacaaacttccctagggacatttagcaaactgtgaagatgagtccccttctctccagagggtgatttaaccaatcatacttttttgtgtgtgtaagatggagtctcgctctgttgcccaggctggaatgcggtggtgtgatctctgcgcactgcaacctccgcctcccaggttcaagcgattctcccacctcagcctcctgagtagctgagattacaggcacctgccaccacacctagctaatttttgtattcttagtagagacagggtttcgccatg[136 bp omitted]gagtagtttgtgtgcaactgttccatctgc[139 bp omitted]tggtgaaaccccatctctactaaaagtacaaaaaaattagctgggtgtggtggtgtgcacctgtagtcccagctacttgggagactgaggcagaagaatcgcttgaacccaggaggcagaggttgcagtgagctgagattgcaccactgtactccagcctgggcgacagagcgagacgctgtctcaaaaataaaaaaaagaaccaaatgaaaattttgaaactgaaaaagataataactgaaataaatccccaattgatggacccaacacaacagagatatcagagaaaagagcaagtaaacttcaaggtaaaccaataaaaattacctaatcccaaaaatagaaaaaacactgcagaaacatgaacagattctgggacctctgggacaataccaaaaggtccaaaattcatgccatcagagttccagaaggagaggagaaagaggatagtacagaaaaatatctggaagaaataattcctgaacacttccccaaatttggcaaaagacaaaaatctatatgttcaagaggctcagcaagtccaaaacaggataaccccaaagaaatccacactcagacacattatcaccaaactgctgaaaactaaggacaagtgaaaaacaacatattatttacaggagaacaactatttaaatgactgtggatttctcatgagaaaccagggtgtgcagaagaagtggaacagcattgtgaaagttccaaaagaaaacaacagtccactgaaaaatctatatgcagtaaaaatctccttcagaaatgaaggtgaaagaagacattctcaaggaaggaaaaccaagactatgttgccagcagacttgctctgaaacaactgccaaaggcagttcttcataacaggcaattgatatcagaaggaaacttaagattgtgaacaatgaaggaagaacatcaaagtggtaaaaatctgggtaaatagaatagattatccttgagttctttaaaatacatttgacagttggaagagaaataacattttctggtagaaatttcaatgtatgtgaaagtaatattaatacataagacaacaaaaacataaaggggagagggaaaagggacttataagatggtaaggttcacacactccatttaaagaggtaaaatattgatgctaagcatgttgtgtaaacttaaatatatatggtaatttgcagggcaaccaccaaaaaaaaaactatgtaactctgtaaatagatatagtaaaaaacacaatagacaaataaaaatgtaatctaagaaaatgttcaaataacccaaaagaaggcagaaaatgagaaacaaaggaataaaaagggagaaaaaccagaaaacaaataataaagtggtaaatacctaaatccaagagtatcaataattgcattaaatgtcaatggactgaatgtaccaattaaaaggaagaagttttcaaaatggattaaaaaaatattacccaactgttatggactgaattgtactcccactccacaaattcatacattgaagccccaacctgcaatgtgactgtatttagagactgggcctttataaaggcaattaaggttaaatgaggtcataagggtggggccctaacccagcagaactggtgtacatataagagaaatggacatcagagcttgctctctgtgtgtgtgagcagaggaaaggccatgggagggcacagcaagaaggtggccatctgcaagccagaaagagtgcccgaggctaaaaccaaatcagtcagtaccttaatctgggacttcccagcttctggaactgtgagaaaattaatttatgttgtttaacccacccaatctatggtactttgttatggcagcccgagcagactaatatacccagctacatgctgtctaaaagaatatactggccgggcacggtggctcacacctgtaatcccagcactttgggaggtcgaggtaggcgaatcacctgagctcaggagttcgagaccagcctgggagacatggcaaaaccccatctctacaaaaaattagccagtcgtggtggtgtgtgcctgtggtcccagctacttgggaggttgaggtgggaggatcacttaaacccgggaggtcaaggctgcagtgagctgagatcatgccactgcactccagcctgggtgagagagggagatcctgctaaaaaaaaaaaaaaaacacaacatacttcaaatataataatacaggtgggatagaagtaagaatggaaaaaagtacaccattgaaatactaaccaaagaagactggagtgaccatatttaataacagccaaagtagacttcagagccaaaactcatccaggataatg[133 bp omitted]accccgtctctactaaaatacaaaaattagctgggcgtggtggtaggcacatgtaaccccagctacttaggaggctgaggcaggagaatcacctgaaaccgggagggggaggttgctgtgagccaagattgcaccactacgctccagcctgggtgacagagcaagactccatctcaaaaaaaagaattaattaattcaccaaaaagatacaacactcctaaaagtgtatgcatctaacaacagagcttcaaaatatatgaagggaaactgatgcaactgacaggagaaacaggcaaatctgcaataataactgtatactcaatactcttttctcagtaactgatagaaccagtagacagaaaatcagcaagaatatagaactaaacaccatcaaccaactgtatgcaattgagatat[135 bp omitted]ccgcctcctgtgttcaagcaattctcctgcctcagcctcccgagtagctgggactacaggcacgtgccaccacacctagctaattttttatatacattcttttcaaatgcacatggaacattcaccaagaaaggccatatcatgagtcggaaacccaaatttaacaagtgtaaaagaactgaaatcacgcaaaggataatgtgttcttagaacataatgaatttgtttatagtaatagataacaggaaaatccctaggtacttgaaaattaaacatcattcttctaaataatatattggtcaaagaggaagtctcaaagaaaattagaaaatacttcaaactgaacaaaaatgaaaatacaacatatgaaaatgtgtgggatg[132 bp omitted]ctgtctctactaaaaatacaaaaaaattagctgggcgtggtggcgggcgcctgtaatcccaattactcgggaggctgaggcagaagaattgcttgaacccaggaggcagaggttgcagtgagccgagatcgcaccactatactcctaagtgacagagcgagactccgtctcaaaaaaaaaaaaaaaaaagaatcaccatatgatgcagtaatatcactcctgggtatacatccaaaggatctgaaattaggatgtcaaggagatatctacaatcccatgtttattgcagcattatttgcaacagtcaagttatggaatcaacctcagtttcaatcagtggatgaacagataaagaaaatgtggcatatatacacaatggaatatcattcagcctttaaaaagaaggaaattcaggccgggagcggtggctcatgcctatagtcccagcacttagggaggccaaggcaggcagatcacctgaggtcaggagttcaagaccagtctggccaacatggtgaaaccccgcctctactaaaaatacaataattagccaggcgtggtggcaggtgcctgtaatcccaactactcagcaggctggggcaggagaatcacttgaacctgggaggcggaagttgcaatgagccaagcagcctgggtgacaaagcaagactccatctcaaaaaaaaaaaaaaagaaggaaattctgccatttgcaacaatggatgaacctgggggacattatcctaagtaaaataagccaggtacagaaagataaatactgcctgtgctcactcatatgtagaagcttaaaaaattcttctcatacaagtagagttgttctcatagaagaccagtggttactagaggcagggaagggttggggggtgggtagccaaaggttggttaacagatacagaagtacagctggataggaggaataagttctagcattcaacaacactgtagggtgaccataattaacaacaatttagtgcatattttcaaatagctagaaatttttgaatgttctcaatactaagaaataaatgtttgagatggatatgctaattatcttgattggatcattacacattgtagacatttaccaaaacatcccagtataccccat[222 bp omitted]aaggcaggggaattgcttgaacctgagagccggaggttgcagtgagctgagatcgcaccactgcactccagcctgggcaatagagcaagactccatctcaaaaaaaaattaaaacattaaataataaaataataaagcaaaaaaaaattctcaacaattggggttagaacaattggaaatccgtatgcaaaatgatgaaacctgacctaatcctcataccttatacaaaaattaatgcaaaagagccgggcgcggtggctcatgcctgtaatcccaccactttgggaggccgaggtgggcggatcacctgaggtcaggagttcaagaccagcctggccaacatggtgaaaccctgtctctactaagaatataaaaattagccaggtgtagtggcacatgcctgtagtcccagctactcgggaggctgaggcacgagaatcacttgaacccaggaggtggaggttgcagtgagccaagatggcgccactgcactctagcctggggaacagagtgagactccatctcaaaaaaaaaaaattaatgcaaaaggaatcatctatctaaatgtaaaatctaaaactataaaattatacaataggagaaaatcttcatgacctagtgttaggcaaagttcttagacatgacaccaagggcatgatccataaataaatgattcataaattggaaattttccaaattaaaaattcttgctctgcaaacaacaatgttatgagaggaaaaggacaagcaatacacttggagaaaacatttacaaaccatgtatctgacaaaggacctgtgtaaaggatatataaagaactcttaaaactcaacagcaagaaaatccaattgaaaaatgggcggaaacttttgaacagacattcatcaagaggatagaccaaaaataaataagcatatataaagatgcttaacatctttaaccattaaggaaatgcaaattaaaatcattatgagataaatgactacataaaaaatactgacaataccaagtactgacaaaaatatggaacaattggaactcatacattgctaggagaaatgaaaaatggttcaaccactctagaaaataatttggcagattcctaaaaagttaaacatacacttaccatatgacctagtaatccaatatttactccacagaaatgaaaacctatgttcacacaaaaccctgtgcatgattgtttaaagtagctctactcataattgccaaaaactggaaataacgcaaatgtctttcaacaggtgaatggataaatacactgtggtacatttataccatggactactattcagcaataacaaagaaacaactactgacacacacaactttgatgaatctccagggaattgtgctgagtggaaacaaacaaacaaatcccaaaaggtcacataccatacgatccatttctattacattcctgaaatgacaaaattcccaaaacagaaaacagatttgtagctgccaagagtttaggaatgggtatgggggaggaagggcagtggctgtggctataagggacaatttgagggatccttgcgatgatggggcttgatcatatcaatgtcaacatcctgactttgatattgtactatggtttttgcaggatgttatcattgggggaacctaggaaaagagtacacaggatttctctgtattattctttcaattgcatgtaaatcaatcatctcagaaagaaaaggttacataatacatgacacctcacttatatgacattcttgaaaagacaaaactacagtgacacagaacagacctaccgctgcctgaggttacaggttggggaagacatgactattaacagagtagcatgaaggagtttttttggggtgatgaaactattatctatcctatagattagttacaccaatctaacaaaaatcaatttcactgtatgttaatttaaaaaataaaaatgtttaaagtgaaagaaaaaatatggtgggctgcaggtatctgaaaaaattttgtctcttggacaaaagataattcaaagtccgactaagaaattgcttcaggaaaatcattggaaagacaagcaggttccctaagagatttcattcccaagttacattttgacatgatgtctccagctcactgaggaaagctgtagcacatatctgcaggaaagcatttgtcaccaggctgtggttgagggcaactgcactatccacatgaagacccagcaaagaaatacctttaaacacaattccaggcaaccttgacttcccatgaaggctgtgtgctctctcctgatgagtaaggtgagccaaggtactggttatgtttccctttggctaccagaaggctcaaagagaaactgacagcccaacatcaatatctgttacaccctgagtcctgcacacctctacattctaatttggccttgatctgttgtctcttattttgcctgatccaatccttatttacaaatactttcctattttatggcagggatttccacatatttcgtcacatccacagtaaaatagaggaatgaagaaacagacaacatacttacctggggtttggccatttcctgctcttcttgggaaaaagcagagatgtgtgacggccgagctggaacaagtggagaagagtacagcagatgaggagaccccatcagactttcagtgcccagaattagctgcctagcaatcccctcacatcagctggccatcagactgctctctggaagagtctgggcaaccatgtgattttaacaatctgtgtattattcactcttcatgtgaacattgaacacaaaaggttttatatacacatatattaaattgtgtactgacccataaagtgtatttgtaggtattttccttaaggaaataatttatcataatgtatcataatttctctgcacgtacccacgtctcagcattgatttcaataatgccaaacttaaacgatcctctatgacccataagggattaataataacaaaatataaaagataaaatgctacaaagctgttaaaagcgttatatggaactgtacagtatctatgcactttgtggtatatgtatctcaactaaacgtttttaaaaggtgtacaaaaaaatcctaaggtgaattacaaagtaggttttaaaactgcgggaatccattttaaagttatatgttaaatgtttaaaaggcatacccctatacacaccaaaaatgtctaaaaacggacatttaaatgtgtgggggaagaattagttcctgttgattttctttttctctatttcagaattaatctatatattcaaatgttatttattaaatgccaaaaaaaactacactctaaaactattatcccaattacattttacccccatctccctcagaccccgcacctacccctcctcccacgcccccaacttgggcgaggcccggggtcaggtgagacctcgcaggtgcctctccttccttctgctcacctcaccggggccgccttgcccagaagccggaaagaggccttcgggtgcgggggtgcaggttcacttcggccggagcattcacaccaggcccccacctcggggcttgggcaaggggagagggcagagggagaagcggggcgcgtctaaagaggggtctgagggatgcgcatgaacctttaggggcaggtcactgtgctggaaaacgtgtaaaagtcaaagtttaataagccccatttaatcctgcttagcccccataactttgttcaccagtgagcccctagaacctcgtccactgacctctcggtcccccatcactcaacccccaactcccacttcactcatcccacagaactccccatcactcagcccacgacccctagcacttgccccctcaacctcactctctctcgataacagattttctgctcgctgctcaggagaccgttacaaagcctggccccaacaagcacttccgcttcgggaccgactctttggcaccgcagcctaaagggctgcaggggtcggttctgcgcacgctcagtggcgcctttgagaccccgtccgccaatagtcaacatggggccgcagcgcaggcgcagagggaaggtagccttgccggtgacgtcactgctccaggccagatggcgtgcccaccgtgtccttttgctgctggggctgcgtcgcaaagcggttgtttacttagttatgcagaggcaggcactcctaagacttcagacaccaattttcttacggcagggcggggaggggaagtgcccaactaaggaaaagattctagcaggcggcaatttcgcactttgaacttggagggcagcaacagagttgcaggtgtaaaataacgggaaggcgggatgcgtggctaaattgctctgcgtgcacaaagagtaggaggtagggaaaagccactggcttcatccagtggccaggactgggagtttacgttgtagcgtttgaaggacggtgggtcggtatgcagacaaacaagctgaaaaataaacggcgatgtgggacacacacaccgggggtgaaggggtatattaagtggtggctaacaggttgctttttctggatgagtagacagtgtcagtgtgttgggagtgtagggggtgtaggctggggccaggtgctgtagggcctccttggccagggagctcatatttcattctggacatatgggaaaccataagaaggatccgatctgtaaagaccagtctgaagcaatctagcattatatagtaacgttaaaaatacacatatattgggctgggtacggtggcgtgcgcctgtaatctcagcactttgggacgccaaggtaggcggatcacctgaggtcaggagttcaagaccagcctggccaacatggtgaaaccccgtctctactaaaaacaccaaaaattagccgggcttggtagcacgcctgtgatcccagctactctggaggctgaggcaggagaatcacttgaacccgggaggcagaggttgcagtgagccaagatcacaccactgcactccagcctgggcaacacagtgagactccatctcaaaaacaaaaaacaaacaaacaacaacaacaacaaaaggaatggagcttcccagtagacaagacaaagaaagaaagaaagtaaaaaaggaactcacatctgttgctccctgacacatcagcacctcctgggtatacaatttatccactctctcaatgcattaggaggtagaaaatagaaagggctggtcctttagggcccatcaagtgtcgccccttctagcacctaaacgtcatctccaaccaccttgtacacacacacctacacaaaggaggaaatcttttagggttggtgggagttggggggcagaggagccagtgatacagcccctcagaaactatccgagggcccacagtgtgcatgcacaagctatgtgaggctaactttgctgctgcagagcgaggactcccactctctgtcctgggtatcctctaccatcattccctacaggtgtgacctcctcatacagtaacctaagcagcaggtggctaggtgaaggagagtgagaagctgacaggtggctggtcccaccacagagtctgcatgatatgacattcccacccaaagacaatgagagaagcccccacgtggctggcgagtcatcattacaattgctcttatgatacattttatcaagaccacaaaaaccttgccaattgtgagcggtcattttggaccagaagcagcaggtgaggctgacagagcaacagcacagaaggagccaggtctctggtgaccttggagctaccacactagccctggattacctgcctccaaaagaggaatctgcttccctcctcttgaagccactggtgtttgtggtggggttggtgcgtgcagccagatcaaatcctgagcaatccatcagatgcttctgtgttggccaatgtgagtgtcagtgaacaggagatacatgggactggtgggtgaggggcatgaataatggtgactgaagggcaaattgggagtaaatgagagcaaggagaggcaaagggcaatggaatggaggtgaatgaacaccagagtggagtggatgtgggccaaagtgagggaatgactatgcatgcattcaattatgaatgaatttgagattatgatgagattaagtaaatgatgggaaatgaggcacagtctcagcggaaaaaaggtgaaagtgggagcagactctgaatgaatggggcaactgaagggggtgaatgtgagtggagtttatgtgagtactgaggattagagtgtgaatgaatggtggttttatgaggcacaagatgaatgaagagaggggaatttagggagacagtaggagtgaatgggggtaatgtgggatggaaagggaagaatggggtgcgggagggacagaataaaagagtggagatggatacatggtagaatgtgaagcaggccgagtttgagtgtgggtgctacgagggagaaggatgactagagatgactgggattacatgggcgttatacagggtagtagcccaggaacgtgggtgcacagggatcccagtgggaatcggcaaatgtgaatgagctgaagagtgcgcatgaatggaggtgatgttgggcagagtgagagggaatgaaagtgaagagcagaggatgggtgaacgtgggtattgtgaggcagagagtggatgaaggcttcatggcctcgggtgagtaaagcgaggaaacatggggagcccgatgtgagcaaaagtaacgaatttgaggcacagtgtgacagaatgcgggtactgggaggcagaatggcagccatgaatcaggagcagaatatgagcaagaagagggtgataggggttacagtgggaatagatttaaaggaatgaggcagtgagaggcagagtaagagtaaatggaaacaatgaagagaaaactgagaaagaacagtgactggagtgcagtggtgcgatcttggctcacttagcgtaggctaagtatatgtgggtaacttcagctagtgtttgggagtaatagggacagagctccaggaaatgggggtgttcctgggacagcatctgagagaatagaggtgaaggaggggcagagggggagtgaaggggggaaataatgaggccccgggtcaatgaaagaagctgaaggctgggccacgtgcgagtaagccagagtcatttgatgcaggggcgggaaatagaggcaaagataggaaatgagtctgagtgagagtgagtggggtgaagaaggaatatgacatgaaagaatttgggtaatgctaagtagactgtggggaattgcgataatatgaggcccagtatgggtgaatataagtggctgaaaggcagtgtaagtgaatggaggaacaaaaggcagaatgagaatgaagttgaaaaagcagtcaagcataagaatgtatatgtaatatgccatttgtaatatgaaatgtggggcacattccagtaaattaggatggaacagcactttaagtgcagagaggtgaacaaggtaccaaggatgagtgctatggtttgaatgtgtgccttccaaaattcagatgtcagaaacttaatccccaatgcaacagtgttgggaggtggggcctttaatccccaatgcaacagtgttgggcgatgttgaggcttctgtgttgcgcgttccagaatctaccacttagacctttgctcatagagcccagagttccagaatgcccctaattccgaacaccacagggtgagtctggagcaagtcacctgggagggcttacaggtgccataatgaaggcctggggcactgtggtagtgaccttggccacgctgatggttgtcactgtggatgccaagatctatgaacgctgcgagctggcggcaagactggagagagcagggctgaacggctacaagggctacggcgttggagactgtgagaatccagttgccccaaatcccatccaaaccctgagccacccgccacattcagacccaggccccttcttgtcctttatcacctctccaggcctgggcatgatcccttgagtcactccctgactgactatgctgagtagtttaactaactctaacaccaccaccattattgccttcacaaccatcacctccatctctgccatcaacaccatcactacaatcaatatcatcaccactgttaccatcatgaataccatcgctaccaccatcactgatgtctcaccagaatcaccaacatcaccaccactaaaccaagatcaccaccctcacaactgagatgacaaccatccctgtcctccccccatcctatccttccctattcccaagctctatacctactccctgcctcccttctccctgccccagggctgtgcatggctcattatgagagtggctttgacaccgccttcgtggaccacaatcctgatggcagcagtgaatatggcattttccaactgaattctgcctggtggtgtgacaatggcattacacccaccaagaacctctgccacatggattgtcatggtaagtcagcactggggacccactgaagccctgctgggccctactctcccacacatggagggcaaggttgtttaagccataatctcctgcaacaagagaaaaatgatgggaaaaggagagaagttgcctgagctattaaagacaccatcctctacccctacccagactatcctgagaggttgtttaggacagaagagctcagagctcccaatcctcacccagaatggacactgcagttttcttagactcaggaaacaggaaacttacctccatgtggaacagagttagaaactgtcctgatttggggttgaggttacccaggccccgaggaaagaagcagagtgtctggttctagaaacagaaacagataacctccatgcagaaatgacagaactttccagataagactggtggtgttgaggacaaaatagaatagccgttaaagttgttcagtgttggccaaaatggtggttgaggttgtccaagacaggaaaaaatggagactgaggttatttggggccagcccaaatggaggttgaggttgtccaggaccagacagtatggaggttggggttattcataactagccaacatgacaatctagatcatccaggatcagtcaacatgagttaaggttgtacagaaccagctaacatggtgattaagatcattcataaccaactgacaagagaatcaaggtcatcaagaatcagtcaacatagtggttgaggttcttcaggccccaaggaacccaaaacccttgggccctccattcactgttatcctatccccagtgcaccagaccaccatgtccctctcttccccctcagacctgctcaatcgccatattctggatgacatcaggtgtgccaagcagattgtgtcctcacagaatgggctttctgcctggtaagttcatggggatggcccaggccatgggcagccagggatagtgtcactgccaccccatcaacctgtccacttcatcctctctcctttccttcatttcccaggacttcttggaggctacactgttctggccatgatttatctgaatggctcaaggggtgtgatatgcatgtgaaaattgatccaaaaattcatccatgactcagattcgaagagacagattttatcttcctttcatttctttctcttgtgcatttaataaaggatggtatctataaacaatgcaaaagatgctctgatgtctgactctcttcatttattcaatgcctggaggtaccctcattccgtcacttcctccatgtattcaaagctctaattaagaaataccagatcactcagagtggggaaggaagggaggatagtgttgtgaatcaagagcatgttgttctcctgggttcagaagccatctctaccacctactagctgtgttgccttggaagagatacttaaattctctgagcctcagtttcctcatctgttaaataaggatgataatagtaactacttgatggggttattgggaggattaaatgaattaatatttgtaaaacgcataaagtgcttggtacataagacagttgtaggtttggagatagaggagtgggatgggagagatgaaaattggcttcccttaaaaagaatcactctcggtggggtgcagtggctcatgcctgtaatcccagcactttgggaggccaagccaggtggatcatgaggtcaggagttcgagaccagcctggccaatatggtgaaaccccatctctactaaaaatacaaaaaaaaatttagccgggtgtggtgacatgcacctgtagtcccagctactcaggaggctgaggcagaagaatcgcttgaacccaggaggcggaggttgcagtgagccgagatcgcaccactgcactccagccagggtaacagagcgagactccgtctcaaaaaaaaaaagggtctttatttaaggcagatacagtctcttcaggggagaatgaatctaataggattgtgcttacacaggaagctcagtgggaatcaggagttaaaggtacgtttccccacatcctcccacataacaccattcttccagcccccagcccctctttcatgatcaaagtctgaagtttaaaatgacagagcgggaatgtaggcaaaacattcaatggacacacgtggtaataatttcttcttacagagtgcctgagtgtcactttgtgtcttgagcagagaatttaggaatttcaatttgccattctttgcaatggccagcacctttggaagcagccactcccataaggaagcagtccctcatgttctttgtactctttgattggggtggatactcaagcacctgagaccttgaagtgttcacttcaaccaggataatcacagatgagcatgaaaacagctagctgccactgcatgccaaggaatgctggagaccccttccttaatgccaactggatttcccccgccttgcaccccaaccagcctaggtaatcaaatctcacatctccctgtgggtccataaagagtgccaacactttgggtactgatttcttgttttttcttattttctttccttctttcctttcttttttcttttctttttctttcttttttttttttttgaaatggagtctcgctctgttacccaggctggagtgcggtggctcactgtaacctctgcctcccgggtttaagcgattctcctgcctcagcttcccgagtagctgggattacaggcgcccactaccacgcctgggtaatttttgtatttttagtaaagacggggtttcaccatgtt[135 bp omitted]taaatctgtaacttcctataatttgataaacccttttgttcttgtatggcacttattctccattatgacaaaacagcgatttttaataatagtagattttattaatttttctatgagagtttggtattaaatctggagacatttttcctgagtatcatttccaaggactatgcttatttaattaattaaattgggtttcctttaatacctgcatctagatttatggtgaggtttggcttccaactgacagccctcataccttcaaggccacaaaaggtgcctctttagctggtcatcagcttgccaggcttctagaaagaataataataatccacactctagcctgtgaatacagctttgtcagaagtaggtctctggtgggactgacttttctttcaagcctatataccagtcagaaagaaattccaagtagatttctttcctacaccctgagcttgagaaaacaaacaaacaaacaaacaaacccaagttgctctaatagaaattggaatgggaaagtgatgataaatataagtgaatttgattgtttaagaaaaatactttaaaagtggggagaggctgggcacggtggctcatgcctctaatccaagcactttgggaggccaaggcgggtggatcacttgaagtcaggagttcgagaccagcctggccaacatgacaaaaacccatctctactaataactcacacacacacacacaaatagccatgcgtggtggcacacacctgtaatcccagctactcaggaggctgaggcatgagaatcactttaacccaagaggcggaggttgcagtgatccaagattatgccactacactccagcttgggcgacagagtgaaattgtgtctcaaaaatacataaataaataaaaataaaataggggagagaaggtaaaaataggtttagggagccatgaacaggggaaagggagattagaagggtagcagatccacgatttgtggggagaaggactcaaatagaacgcaaatagccttttaggaaagctggaaacaaatgaggtgaccaagagaataagcagaaggacgaggccagattgtggtgaggctagctcttcaccatctcactccaacattactgtgagagaatagctcacaaaactaacaatttacag[302 bp omitted]cagagtgaggctccgtctcaaaaaaaaaaaaaaaaaaaaaaaaagaagatatttctgagctttcaaagatgtccagccctcactgacccactgcagtatccttctcatgacttcccatctgcttgcttgcttgcttgcttgcttcctttctttctttctttctttctttctgacaaggtctcactctgtcacctaggctggagtgcagaggtgcgatctcggctcactgcaacctccgcctcccgggttcaagcgattcttgtgcctcaccctcccaagaagctgggactacaggcatggccaccatacccagctaatgtttgcatttttagtagagaaggggtttcaccatgttggcctagctggtctcaaactcctgacttcaaatgattcacacgccttggctttccgaagtgctgggattacaggcgtgagccactgtgcctggcctgctcatttctttcttagctgtacaactcaaacttgggacttctctctctgtgatccaaagtcctccttcctccaaagaggcaatcacatctggtttggtcacgggataccctgtaacggaaaatgatacaagacttgggcacgtctgtgtgggctttgggacctcaaaaagttaggaaggcacatattcatgaggctaaatttcacataggagatgaaaatagaaacaccttgttcagtctaggagggattaagcatctttaatccctagaacctgaggtcaaaatattgaagcacttcagagatggaaagttattctactggatataccatgaattactcagagaagccatcctcacccacagagaccagaaggctgtagttctgtagtatcacatctctatatctctctatatttctctagaatcacaaggtcctctgaggaggatccagtcaattccaccactcctgggtgaaatccgcaagacacatcatcaaatgacacgatccctgtaacggaatgcttctattcaattggttggataaaaattaaaatgataatactttttaaaataaagaaaatattcttcagagagaagctactctttaaccatttcaaaaagggcttttctgagatattcgcaatacctatatatagcaaaggacttttatactacagaaactataaagaactcctacaaacaataagataaatatagatagataatccagtagaaaaaacagaaaaaaagatttgaacaggtaattcacaaaagaggatatccaaatggccaataaatgtatgaaaaggtgctcaccatcattagtcatcagagaaaggcaaacttaaaccacagtgagataccactatatgccaacagaaaactgaaattaagaccaacaaccttcagctttcctgaaaggctctttgaattctttttttttttttttttttttttgagatggagttttgctcccatcacgcaggttggagtgcagtggcacgatctcggctcactgcaacctccgccttccagtttcaagagattctcctgcctcagcctccgaagtagctggcattacaggcgcccgacaccacgcccggctaatttttgtatttttagtagagtcagagtttcaccatgttggtcaggctggtctcaaactcctgacctggtgatccacccgcctcggcctcccaaagtactgggattacaggcgtgagccaccccaccaggcccagctatttgcattctatttgagtctttctccccctaaatcctggatctgctacccttccaatttccttccaagtgttggccggatgtagagcaactgaagctctcatacattgttggtggaagtaaaatggtgtaggcacttaacagattggtagaatctactaaagctgaacatctaaattaacatctaagttagtttatctaacttatctcatctgcaagaggtagatgatacacctaacctaggatccagcaactccactcttaggtatatatccaatggaaatgcacacatatgttcaccaacacatgcacaagaatactcacagaagcattatttgtaatagctaaaatggaatatccaccagcaggggaatggattaacaagtgtgttatatttatacaaaaggaatagtgaatagtatggaaaaagaacaaactactgacacataaggtaacaaggatggatctcaaaaacattatggtaagtaaaagaagccagacccaaaagaataataatgtataattccatttatatgacattcaagaactggcaaaaataatctatggtgatagaaatcagaaagtcgttagctgtgaatcaagagatagtgattggaagtggcatgatgaaggcttctgggtggcttgtcatttcctgctttttgatacaggtatgggttacaaaggtgttttcacttggcagaagttcattaaaccatatactttatacacttttctctgtatgttctgcttcaataaaaggtctgacccaaaacatttttaactaagttagttttccatacaaggttttaaaaaacagtaagagggccgggcacagtggctcatgcctgtaatcccagcactttgggaggctg[134 bp omitted]gaggcaggagaatggcttgaacccggaggcaaaggttgcagtgagccaagattgcgccactgcactccagcctgggtaacagagcgagactctgtctcaaacaaaaaaaaaaaaagaaaaaaagaaaaaaggaaaaaggccgggcgtgaggctcacgtttataatctcagcactttgggaggccaaggcaggtggatcacctgaggtcagaagttcaagacaagcctggccaacgtggtgaaaccccatctctattaaaaatccagaaaatattagctgggtgtggtggcgcatgcctgtaaccccagctacttcgtaggctgaggcaggagaatcacttgaacctgggagggggaggttgtagtgagctgagatcgtgccattgcactccagcctgggcaacaagagctaaactccgtctcaaaaaaaaaaaaaaaaaaaaaaagtaagagaaagatttaaaaatcccacaggaaaaagagtagcatttgggaaagaatgattcacaaaagaaatatgaaaagaaaaacgtatgaaaagatactcaatttcattgacaaacacacacaaaagaaatgagatattttcaactatcaaatggcaaggattagctctccctctccctctccctctccatctccctctccctcatccctctccctcatccctctccctctccctctccctctccatctccccctccccctccctctccgtctccctctcccctttgcacggtctccctctgatgcagagccaaggctggactgtactgccgccatctcggctcactgcaacctccctgcctgattctcctgcctcagcctgccgagtgcctgggattgcaggcgcgcaccgccacgcctgactggttttcgtattttttggtggagacggggtttcgccgtgttggccgggctggtctccagctcctaaccgcgagtgatctgccagcctcggcctcccgaggtgccgggattgcagacggagtctcgctcactcagtgctcaatgttgcccaggctggagtgcagtggcgtgatctcggcttgctacaaactccacctcccagctgcctgccttggcctcccaaagtgccgagattgcagcctctgcctggccgccaccccgtctaggaagcgaggagcatctctgcctggccgcccatcgtctgggatgtgaggagcccctctgcctggccgctcagtctgggaagtgaggagcgcctcttcccggccgtcatcccgtctaggaagtgaggagcgtctctgcccggccgcccatcgtctgggatgtggggagcgcctctgccccgccgccccgtctgagatgtgaagagtgcctctgccccgccgcgaccccgtctgggaactgaggagtgtctctgccccgccgccaccccgtctgggaggtgaggagcgtctctgactggccgcccagtatgagaagtgaggagctcctccgcccgcagccgccccatctgggaagtgaggagcatctccgcctggcagccgccccgtccgggagggaggtgggggggtcagcccctgcccagccagccgccctgtccaggaggtgggggggtcagcccctgcgcagccagcagccctgtcagggaggtggggggcagcccccaccaggccgccgccccgtctgggaggtggggggcgcctctgcccggccaccccatctgggaagtgaggagcccctctgcccagctgccaccccgtctgggaggtgtacccaacagctcattgagaacgggccatgatgacgatggcggttttgttgaatagaaaagggggaaatgtggggaaaagaaagagaaatcagattgttactgtgtctgtgtagaaagaagtagacataggagactccattttgttctgtactaagaaaaattcttctgccttgggatgctgttaatctataaccttacccccagccccgtgctctctgaaacatgtgctatgtccagaaacggttaaatggattaagggcggtgcaagatgtgctttgttaaacagatgcttgaaggcagcatactcgttaagagtcatcaccactccctaatctcaagtacccagggacacaaacactgcggaaggcggcagggccctctgcctaggaaaaccagagacctttgttcacatgtttatctgctgaccttccctccactattgtcctatgaccctgccaaatccccctctccgagaaacacccaagaatgatcaataaatactaaaaaaattaaaaaaaaaatggcaaggattaaaaccatgacaagaagattagaaagggtattttcattcattattagtggggggtgtcaacttgtactaacttttcaaaaggcaatttggcaatgtctatgaaagttcaaaacgtgcccaccttttgaaccagacactctagaaatgctcaccactgtgtacaaagatagatgacaagataaaaaaaaaaccaggtactgctgaggttgtagagaaaagggaatgcttatacactgttggtgggaatgtaaattaactcaaccattgtgaaaagcagcgtggcaattcctcaaagagctaaagagagaattaccattcaacccagcaatctcattactgggtatacagccaaaggaatataaattgttctaccacaaagacgcatgcatgcatatgttcactgcagcactattcacaatagcaaagacatggaatcagcctaaatgcccatcaatggtagtctggacaaagaaaatgtggtacatatacaccatggaatactatgcagccatcaaaaagaatgagatcaggccaggtgcagtggctcatgcctgtaatcccagcactttgagaggccaaggtgggaggatcatgtgagcccaggagttcaagaccagcctggacaacataacaagacctcatctgtagacctcgtctctacaaaaaaataataataacaattttaaaaagaacaagatcatgtcctttgcagcaacatgaatagagctggaggccagcaacatgaatagagctggaggccattatccttaacacactaacacaggaacagaaaactaaatactgcatgttctcacttataagtgggagctaaatgatgagaactaatggacacaaagagaggaacaacagacactggggcctacttgaaggtggagggtgggaggagggagacgatgaaaaaaaaaataaccattgggtttagtaccttggtgatgaaataatctgtgcaacaaacccccgtgacatgagtttacctatataaccaacttgcacatgtacccctgaacctaaaataaaagttaaagaaaaagacgacaagagagatcactgccacactgtagcagaaattacacagaagtccttcaatatggggctgattaataaatcgtagtacatgcatacaagaaaaaaaagcatctcttaaaaatatctctatgtcctgatactgaaataccttccatcaacaagtgttcattaagtaggggctattccagctatgccagtgagcagctgtgcaagcccatgcaatctgcttatccactctggtactcagcttccttagctgtaagaggtagataaaaatggtacctacttcctaaggtcattgtgagaattaaaagtgatcatgcatatataatgcttagtatggtgtcaggtgcagtgtgagctcactacatgtcggctcttgttgtgtcacttttgttatcattatcatttgtattatcattatcattaccactatgaccattattaatactattctgggcaaatggaatggcaaaacagttttacataatgagcagattttagcaaaaggaagacatttacatacgtatatatttatatgtgtatgtaaatataaagagaaagaacaagggggagagagaggtgtataggtggaaattaaccaaattcatcagaaattggttatttggaatgagtggtgatatgagattataagtgaattccccctttcagattgtatattcctcaagagtttggatttttggtgtgccacttctaaatcacttctgtaggaagagaaaaaaatgacaaaataatatagactttcttaaaaagggcagaagggaaagtactgaacatgcttagggacatcatgaattctgagcctaaaaaggaaaagggcagacctttgggttgctcaggctgttctgaaaccccagatgtggaaaaactacatatagatcagaaaagaatttgaagggcatgaggtttactgattcttcctgatgatcaaggtccatatattgagccagaacataagagctatttgtgcagacatggctttgatttcctgaagagtcacatatttttagttctgctttagcaggacacctttggttgacatgcagacatattttaagtcacagcagagcaatcctatctctgtatttatcacaagattgctgataagggacttggctgacgcatcagagaactgtcttatcaaagaaatctttgcttctgaggaagtggcttactttctctgtatgggtgagataaataaagcaaatgagcttttttccccctctatgttgtggcttctaggaagctcagaaaaataactgtagctcaacataattatgtagaatcctatgatctacatatagacatttcaacctggccttggttttgctctacttccctattccattttatgtgtttatatgtatccattttatggtattaataatagtataataataatattaaactcatatataagacttacgtatgtgctaggcattgttgtaaacacttatattgactcaattgatctacacaacaaccatacaaggcaggtattattattattatcattaacatcatcatccctattttacagttagagaaactaaggcacaaagaggttaaatgacgactctgtccgcagaccaccagccctctcacttccgttcgatgtaaactctctgccccgcctcataccctgctctgatgttaagatccgaatgcttattcaggcaaggtccccttgtgtttccaaaatcagtcacaacttcctctgacagccacctttttccgacctttatcctgcattaattaggtactgccagtcactatacttgctcatgcgcagtaccgttcccaaagccgtcggtgctagcagccaaagttgttctgtggttttctttaatttaatgattaaatttttttaattgtacatatttgtagggtgcagagtggtatttcaatacatgcatacaatgtgtaatgatcaaatcagggtaattagcatgtgcatcacctcaaatatttatcatttctttgcgttgggaatattcaaaatcctctcttctaggtatttgaaaatgtacaataaattattgctaactatagttattaagcagtgctatagaacaccaaaacttttttgttccttaactgcaatgattgtacgtatttggctggcaagaaaaatggccgtgccagtaaaccagcttgtcaagggagcaggcatctttacagcccttaccattccgtacaggagagtaatatgccttttaaagtttggaaaagatagaactccgagaggactttgaaaacttggcgataaaagtggggccctttgtgcaaagctagtgacgggcaaattatgggcgtgtttgggggggtttcaagagaacgggtatgtaaaaatgttgagttcaggaccacagacccctccgccgggagataccactgcggagacgggggacgcctgaaatggtacggacatccctggtacctattaccggggaaaaaggatgcagagccggtgataatacattcctccaccggtcagtatcagtggggagatggggagaacgtgtggagctggtactcctctcaagaaaataacagtagggagatagatactattaagctagcggtggcgaaggctcaggttggtacagtccgttgtgggagataccactggtgcaaatagggaggtgtggtacaatctgccctcggagaaagaaacgtgaagaaagtgacattggtaaacataggcgcagggagagttggagacataagcccagggataaaggggcccaggtgaggtggaatattagtcggagactaggtgagaagacagatctgatcgcgaccccgccaggactacattccatcctcctcctgggaaactgttgcagagagatttgagagggcggagattccagggtcccagtcctatgaggcctccctgaggcctaggggaataaacaggagacagacagtgatcaggttccggacctcaaacactctcccctattaatcatattctaccaattgatcacctgaaagaaaatgcacaggtgagccctttcagcctattgcaatagggaaaacttttcttaatgaggaacatcccaaagacaaggaaagagacctcgggttgtatagaggcaggtaagcaaaagagtcatccttgagtcatcaatcaggacagatagagataggtcttatctcagaatgtgtaaatacattagggactactatagactgaattgcgccccttccccccccccccccccattcatacgttgaagcccaaactgtcaatgtgatggtatttgaggatggggcctttgggaggtaattaaggctatatgaggtcatgagggtggggccttggtctaatgggattagtgcccttataaaaacagacgtccaagagtttgctcactctctctccatttgcacaaaaaagaggtgatgtgaaaacacagtaagaaggcagttgtctgcaagccttatggctttctttatagagaaccctcaccaggaaccaaatcagctggccccttcatcttggacttctcccagcctccagaactatgccaaataaacttctggtttaacccgtccagtctgtggcattttattatggcagcccaagcaggtaatccagggacttttgcagttagccctttgctggaaccccaaagggagccaggggctgtgagaattttgtaaccatgactgctttccaggagcacaggacccactcagatataaagtaacagcatcactccccttccagctcactctgcccctcatggctcctactccttcccactctaccaatcattaacatgtattctctcccacggtgcccccaatttcccgccattcagtcacactgccattttctttcattcattctgcttcatggccaccattcacgcatcttgtaccccatataaacacctttctttttattgtggtaaaatacacataacatgaaacttactattttaactattttacattgcacaattcagtgccatttaggacattcacagtattgtgcaaccattaccactatttaattccaggctgtcttcaccaccccaaaaggaaacctcatccccattaaacaatcattccctattcccctttccccccagcccctggctaccacttaatctgctttctggtgctatagatttgcctattatggatatttcatataagtagaatcatacactttgtggtcttttgtgtccggcttctttaacgtggcataatgtcttcaaggttaatcagtaacagtacttcattcctttctgtggctgaataatattccattgtatggatatactataccatatttggtttatccactcatcagttgatagatatttgagctgtttctaccttttggctattatgaatagtgctgctatgaacattggtgtgtaagtttttgtttgaatacctacctgtttcccattttattaagtatataactaggagtggaattgctggatcatgtggtatttctgtgtttaactttttgaggaaccaccaaactgtttcctacagtggctgcaccattttactttccaaccagcagtgtattagggttccaatttctccacatcctctctaacacttgttgttttgttggtttttattgtagccatcctagcagacgtaaagtggtatctaattgtggttttgatttgaatttccctgatgactaatgacaaatcttttcatgagcttattggccatgtgtatatcatgtatatcttatttggaaaaatatctattcaagtctttgcccagtgttaactggggattttttggttattagattgtaagagttctttatatattctggatacccttatcagattataattttcccattctctgggttgtcttttcattctcctgataatgtcatttgatacacaaaagttttcatttttattaagtccaattattcattttttttctgttacttatgcttttggtatcatatctaagaaacaattgccaagtccaaagacgtgaagatttattccttcattttcttctagttattttacagttttagttattgtatttaggtcttttatccattttgagttaacttttatatatggtatggggtcatggtacaacttcattcttttacatgtggatatctatttttccagtgcatctgttgaacggactattctttccccattaaatgatcttggcaccctaatcaaaaatcatttgagctgcatgggttttttttttctggactttcaattctattccattgatctatatgtttatcctggtgccagcaccacactgttttgattactgtacctttgcagtaagttttgaaatagggcagtgtgagtcttccaaatttgttcttctttttcaagattgttttggctatccagggacccttgcaactccatataaattttaggattagctttcccctttatgcacaaaagggatttgggattttgttagagattacattgaatttgtaggttgctttggggagtattggcatcttaacaatgttaagttttccttaattatccacgaacactttccttttatttagttttattttttatttagtttttccttttatctagttttccttactttttttttttttttaatggagtcttgctctgtcacccaggctggagtgcagtggcgtgatcttggcttactgtaacctccgcctcccaggttcaagcaattctcctgcctt[226 bp omitted]atctgcttggctaactttatttctcagtattttattctttttatcctatcgtaaacaaaattgttgtcttaatttccattttggctttttcattgatagtgtatagaaaagcaattgatagttgtatgttgatcttgcatcctgccatttagcaggatttgtttatgagttctaacagttgttttttttgcagattatttaggattttctatatatatataaatcataccatctgggaatagaaatagttttactttctttctaatttgggcatctcttatttctttcttttgcctgaaaatttatctggctagaactttgagtacaatctttaatagaagtgacaaaagtaggcatccttatcttgttactataactctctacccttaaacttttatgccagaatttctaaggaccagatagaatgaattatgcctttactgttatataagtaagccaaagatggcctctatgtttgacccccaggttgtttatttcttcactgcaggctgagaccccttaactcaaaagtttgctggcaccaaacaaatttttacatacccaaatatttcataaatagcccaaacacatagatttttagccactgagagtcttcctgctttacataccccagaaaacctggtactacatctttcatctttggggaatagataagttaggccccaggccataaaatacccaaagctgctgctgctgcccttcagagttctctgacccagagaattttctctttgctgctgaatgacatcacctagacaaataagcccccgtcttgatgccccagcacttcccttgtcgttctgcccttccgaatagttgaccagtggccataacctctgtacaggctcgggctgtgagggacttcatgcaaacctgtcacagaatcaccccataacccttattgtgctacgccaccttgtggtcatttatttccttcatcagcgccctaaatcgctcaaactccctgtaagtgacaaagaggaaaagggaaggatttctggtaatcatgaaatagataggagacagtaggacaagtaattggtaaaagaatcctggatggtctcaagcggtggaactctaaacttggaatgccattgcatcagtttggcatgggactgctttgtgctgtgtcacatactctacatttgtgggttttctctgtgcctcactagcctggccaagcagtaacaccagtatttgaatgaatccacttcattagaactgacttttgggatcaggtgtggaactgcctggggaaggaggtcaccctgcccgcctggagccccactaggcagggaaatgctggggcacgcacagggcgctataaggcctgtgggtctgaacacaaaaggttgggggagtacacatctctggactgagggtgggctatcctgaccccatgactggctagagtggtaggagccccgtgagttggccctgtgattttgggtaccctgagacgcatatgacacgtgaacatggctataaagcagcgatgtcgggctgacgtggatcccctaagcacagctgggggaggcgcttttgtaaacagctagcatgcctctgttcttgtcgcatttgaatttgctattacagatgacatcatttctgttcctttccggagcaatatcaagaccccaaatttgttgaggtggggcaaaactgttacttcacgtgactaaagacgtttatattgctgtcccaaccaggactccaaaggaggtggctgtccacttgaatccaaaccaggggacccatgttgggcttgcgcgcttctcgccaggacacggcccagagggtaggtctctcattcatagtagccacattaagcctggctgtctactctagtctatgatcggggcatagaataataataacccttattgtgctacgccaccttgtggtcatataatcttctttcatcagaggagaccagaaggcgtagaagaccccggagaagaggactggcgccctctagaggatgacgcgacacaataccaccatgagagagtgaggaacttgaccttctcctttgccagtcaccaacagcaaagtcaaaaaaacagaagagacaacaggggagggtcaagaaggagaggccatttctcatttggaggaggagacaccctctgtctcacccggagcccctgcctgtccgta[219 bp omitted]ggctgaggc[138 bp omitted]cagagcacagcaagctccacctgacaggggctgaagtgaagcacttggctgccccaggacggtatggaaaagtggcttccctactaaaggattctgcacagttagtacagaagctgagagtgactcccaggaggctttgcattgcagtccatgtacacctggtcagtatggattttgcatttttgtgaattttggtggcttggaaagctgcccaccctacacgaggcctcacaaccccctgggcagaatggcggtggaaaacgttagctgaggccaaagatgtcctccatcagctctgcacattccagtgggattatctggtgacagatggcagggcatgaggactctatagtctgaggaggctgaatggagtgctgagcccacacagtagtttctcagggagcacctgacaagtacaagtcctgatttctgtcagcgatggctaaggctaaacaatccaccaggccatggctgccctggatggaatagaatctcatggaggacaaactcacagcccagtgttgcctgcagttatgaaaacaatgccccacctggcctaaatcacaaggaacatcaccggcaaggccgccccctcatagtgcaaataaaccaccaccagccaggcccccagttgagcgggaaccctgagatgcacggaagaggtcatctattagtcagggttctgcagagcaacagaaccgataggaggcgatatgtctacgtctatgtggagatatgtgggatttatcgtaaggaattggcccacatgggccagaggcccacagatcccaagacctgtagttggcaagctgggaacccaggagagcgggtggtgcaggtccagtgtgacggccagcagacttgaggccaatgaagagctgacgttttagcgcatgctccaaggcgggaataaactgatgtcccagccccagcactcaggcaggaggagtcctctctgactcacggagggtcagcagtcctgtttgcctcaggctttcaactggctgggtggggccccccacatctaggagggaggtcagcttcacttagtcttccagagaaaggttaagctcacccagaaacacactcacagccacacccaggacagtttgatccattgtttaggcaccctgtagcccaggcaagttgacacgtaaaattcaccatcccgggttgtatggagcctcaagggacaagaggatcccaaattggatgtgctctgataaatcagtgcaacaacacaatacgagccagggtgaggggacagccatggcaggcctctgcttccaaggcagcctcaccttcaacacctgccttgatctctgccagtgacagggacccaccccacacagatcccgtggtcatggaagcaggtccctctggcagacaatcagccttttccatattaactgtggtttgcccttcagcaaatcaacaccacaggccaatacaggtgctggaatctccctcatcccaggcaacattcaagctttaaagggccctccccaggaggtggcccgcttgggaagaggaaccaggaaagcatcatcaccctcttccctattcaggttggcccagggttgctaaaagacgtttctgtcctggttgttgtccccaatctgccccttttcccatcgctggaacgggccctctcagtcagcgggtgacctcagagaacggcctaagggtcctgtgctattgctgccactgacaggtgggagccagttaaccaagccccttcccctgctggtgtggggttccacacaccccatagcagcggaggcaagtcctgctgcgctcacttggttagggaaagggaacgaactcctaccatctcaccttccagctccccagtacgagctgtgctgaaagccactactaatgtgtgaggctaactccagactacggagccttaaacaaggctatccccttgcttagagcacttctaccagacatctttgccttaagacgacattcaaaacaacctggctaaatagtttggagttgaagagtctgctgacatgttctgttctgtgaaaatgtcccaggagactcaccacaatcgccttccccttcagggccaacaagacaccttgtactggtcgactctggagtggttcagtagctgccccccaccacgattgcacacgggatttgcacacaggctttgcacacaggacctgagtgctgcctgcacccccgtcagagctcggctttgccatcacattggcaacatcctcgtcactgaaagggaccaaggcgctgtcccacaggtggtcgcagtcttgagcaagcacctcactgcgaggggatggacaactgcccctctaaaaggtccatggcccctccgggtctgttgaattcgggggcaacgtgtagaactcagaagggcaaactgtacctgatcctgtaaaagacaagctctggctgggcgcggtggctcatgcctgtaatcccagctactcgggaggccgaggtgggtggatcatgaggtcaggagtttgagaccagcctggccaacgtggtgaaaccccatcgctactaaaaatacaaaaaattagccaggtgtggtggcaggcgcctgtaatcccagctacttgggaggctgaggcaggagaattgcttgaacccaggaggtggagcttgcagtgagccgagaccacgccactgcactccagcctgggcaacagagagaaactccatctcaaaaaaaaaaaaaaaaaaaaaaaaagacaagctcccagaactgcagcctcccacacgcccaactgcagcagatgtatttggattctggcgccaccacatcccccacttccaatatttgctgggcgctatctgtggagtcccccttacctcttccactctccagtgggacctgagcaacagaagccacataaacgcatgcaggctgttacctcagctccctgacctgccccgagggcaggactcacagtgagaaggtccagccgcctccaaatttgcttcctggagcatctgccccaaatgcacaagcgagcacctacccatgggcttcagctgtaggcggctgcagcctcagcccaaaggtattcgccatgagaaaggcaccacctggcagcgccctgggcacttctggaaatggaagcccttcctgggacatagcccatcaccctacacgctgagattcctagtatgccccgtgcagtgggagaagctccccctaaaaccctgatcaaaatagaaatgagctccactggctccagctaaactcggccctcctggagtgccacaacctccatgagcaaactgccacgtgccctgactgtgacacgaactttagaaaccctagaaatgcctccaccccttgctcaaggggagccaaagggaggaaggccacagcactctcaagacaggaaaagcaatgctctttctttacagatggagcgaacatggggaatacgagagccagacacccgcagccccgcaccccaggccaccagtccactttccttgtcggggaggggccccagtgcgggcaggctgagctgcgtgcaatactcctagcaacagaccatgctcttggcaaatattttcccaaggtgtttcactgactccaggtcagaggctaatgggctgactacatagttggggcattaacagaatcaaggctgaaaatacaaggcccagacatttgggataaagagatggggtcaggggcaggggtggaaattgccaaattcaccctgctctgcccatggttgtgtaccatacctccgctcacattaaacaagatgtgtaggaggtgcgataccatgctgaagatgagctaacccaaccagccaagcaggcagggctgcgaaggagggcgagtcctcagaccctggagacaagccacctgaccccttctacaaatggacacatgaggtcaaggcacttgggcaccatgaggttgtgaaaatatgttgttaagagaggagttgatccagtggagggacatttaaacaaagtcatagggaccgtaccaggtgtcagcaatccagacattgggaccacctcgtgggaggaaacatttggagaggagaagggctacattaaaactggcaattcaactccattgggcatctccctgcagcagctggaaccgtgaaatatgcctgaacagcggtggatgcctacacagtcatctattggcttacccatgcaaggtagcagcctctatttacgttattgcagtgttagcacatcagcttttacagcatttggatttgccacaaggtgtatgatcagatcaaggctcctacttcaccgcaaacaaatgcagcagtggatgttacaaaatcacattacttgggttttccacctaccccatcaccctaaagaggcaggtatcagagacagacatgatgggatttttttttttttagaattggaggccgggaacggtggttcacgactgtaataccagcactttgggaggccgatgcaggtggatcaccggaggtcaggagtttgcaaccagcctggccaacatggtgaaaccacatctctactaaaaatacaaaaattagccaggtgtggtggcacacacctgtagtcccagctacgtgggaggctaaggcaggagaatcgcttgaacccaggagacagaggttgcagtgagccgagatcacaccactgtactctagcctgggggacacagcaagactctgtctcaaaaaaaaaaaaaaagagttgtagatgaggtcttgctatgttgcctaggctggtcttgaccagctaggctcaagtgatcctcccacttcagcctctgaaagttctgggattacaagcatgagccaatgtgctccacccacagtgggcttttaaaacaaggactattgagagaacctgtaggaaaatgccccaccaagtggtaaaaaaaatactgcccataggcctgatcattatttcacatgcctatgccataactacaccatattgaaattcacgataaatgaggagactgccaacaggacactgccacccctgccggtgtacacgcccacaccagagatagttaccggctttcacaagactcaggagccttgatgtagttcccacagcaaaggaactttcatctggtactttcatatttaccttctgcctcctggagagtgcagggccgagccacttcccttcaatcccaatgaggatctgacaaggaccacccactagaaccatcctcagcctgtgtctcctcacccggtggagcagcaaaccacctgccaccatctgcggagagagacgccctcatccgccgcccatgtcctccactgaaggtaccgtgggacacacctggacctgttccccacacccaggacatgcactcatcacctctgaaccactaataccacttgagcaatacccaaaggacaatctaatccctactcctggccacaggtgacctctgactttaacccctactctgttgctgtgcccttttcttacctgagaagctcataccctcaccagtgtcaagtacacatccactgatggaacaccctaccctgatcatctacaccctactgctgaccaaggtatgtctggaaatactatttcacatgtaccccatggggtaacacatgacacagggcatctggggatgatgggaaccacactgttggctatttgagctggtcattcctactaacacaaccagacatcaaccctgaggctagcatgccttctcctctctctgctactgcaatcaacacccatttcaactaagccagactcagattatcacttgtgaatcatgggtgccttgtaagtcctatagcgcaacttttgcttcaaattcaataaaaccattattaacaactgccatccaacagggcaatgggccatacctatggagtctcattgaaggcatgcccggagatactgtggatctgacagtgcaaccacgatgctcatgactggtgcaatcaaagtaaaaatgctgaatccagccaataccagtaagccctaaggattacagaaatcaaattctagctcttacaaatccctgggatgatgataagtataaaccctgccaccagtgtacacccttacaactcctggcctctttttctgcttctcataatgatctctgtccctttccagtacaagccccgcttgctaagaaattgcactaaccaagtggccaagggcatctttccatgaagcctctccctggcctcttcaatatatacagaaaagcgatgcatgttacaccatgttatctgcaccaaggcatgtctacaatatcagggattacaaccagcttaggaattctttcctaacctaatctcacaatcccaacagcaagttttacatcacactcagtggaaatgggctctatgctctgcaacaattgcaacagtggctgcccacagtgagccatcaaagttcttgggtgttacagcaaagacaattcttaccaaaaccatatttgggctgggcaaggtggcacacccctgtaatcccagcactttgagaggccgggctgaggattgcttgagcctagaagttcgagaccagcctgggcaacaaagtgagaccctgtctctacaattttttttaaattagtggggcatggcggcaccgcctatgcctacctactcaggaggctgaggcaggaggattgcttgagtccaggagttcgaggctgcaatgagctgtaatcacatcactgcactccagcctgggcaagagtgagatcctctctctaaaaaaggaaaaaaaaaaaaagccacatttgatcccatggagaaatctaactgctctctacctgggactttctccactcaaatcggcaactaattgtttacgccacttgct[137 bp omitted]gtgaaaccccatctccactaaagatacaaaaattagctcgatgtggtggtcggtgcctgtaatcccagctacttgggaggctgaggccagagaatcgcttgaacacaagaggcagagattgcagtgagctgagatggcgccactgcactccagcgtaggcgatagagtgagactccatctaaaaaaaaaaactgtacaaatggctgccctagaacagtttccccaaggatgaaaggagtggagcaactgtcccccacaattgggaattcccaatcttttaaacacaggacagatatggctcaaacatagaatacaattgatgtctatgtttgaaataacttggatgcccctgtgaagatcccatatgtgagtgccccttagtacagaatctactttggtatggggctaaattaacaacttttaaaaaaatgctcagaacacctgcaaagtttatcccatacccatggaagtacaaagatgctatttaatatgggcaattggcaagaaacttgaataccaatgcacaccaatcagaacgaagaggaacataataattgcccaccaaacctagcatgcatatatatagccttagccacagtcatccacaaatggcaaatttaactgcgtgcttacttctgccaacctgattttaatccacatagtgtaatttctctctcccagccaagctccccaacaaacctcactcatcaagatgagcctaattccctggctatagacatccaacagcaatatccagaggttaatctcatgcaaatatgtggacaatggtgggctgagcccataaccaactgagttgacccaggtgctgaatatggggtggataacatgcacatttgtttccctgtaacattataagttcctattaacaccacctggatttgtcctaagccacacaaacttcccttcataggaacatagagaatgcaggcaggagaaggaccctggtgggtctgtaagggaatcaaagggcttattacaagctcccgcttatctgacactgtaaaatatttcctgcatttggatttggctcaaaatttcagtagatttttactcagcaatggaattctctgaggactcgcctctataaaccacgctggctgcaattctctgatgccataaacgagctttccaaatacctcccctggaactaaccaccttagaatcactaattttaggagcagtaggaacagcatatgtgcaggacaccacaccacaatttaaaaaagaaatgcagatagctgtgtccaaggagttgtctacgtgaattagatgatggcccaagaaccaagagctcttggtcaaatcctgctgtactgtccaaccatgggggccatggtgtaagataactgcatagtcctagattacccactggctgctgaaggagaggtctgtgcacttattaatacatcttgctgtatgtgagttgtcaaagaaaaacaaatcagggcttattaaggagaaacttttgttcaaaaagatttttgtggggaaggagaagagactattgcaacagggagagggggatgattgcaatagggagtatgctgtgaccataaggtctccaaggcgatgaaaaccaggcaggaaaaaaaggcttttcttgtagagggtaaggaggcaggcagagataagcagaatctgtggagaggaagctgcacaaataagagggaatgtccagtggggcctgccaggaaaatgtcccaccgtgattggcccattcccaggaaaggctgagaagcaggggcacactcctccttttcgtgtgtttgcacaggcttagggacaatcagagtttgggggcctgtaggagagagagaagcctggctcaagtttggtcaagactaagcagacggtaagcaatgcatgactgtgaacccttgatctgtttcctctgttgttttaagtgtttttctttgacaactcacatacagccagatgtattaataagtgcaaagtctatcctgaaactctattagggatggaataagaggcattgtgaggttgaattttctccaaagaatgtccatgagtgtattagccttcacattcttgttactgaaggacgactgtattatctgtcgagcatgctatcagactgacagctgtcagaaggactttgagactaggcacttaatgagaataggataaaaataatagttttgaaaagttgaataaggctgggcatggtggttcatgcctgtaatctcaccactttgggaggctgaggcaggcagattgcttgaacccatgagttcgagaccagcctgggcaacatggtgagaccccatgtctacaaaacaaaatacaaaaaaaggccaggcacggtggctcacacttgtaatcccagcactttgggaggacaaggtgggcagatctcttgaggccaggagttcaagaccagcctggccaacatggcaaaaccccggtctctactaaaaatacaaaaattagcagggcatggtgacgcacgcctgtaattccagctacttgggaggctgaggtacgaaaatcgcttgaacctggggagtagaggttgcagtgagttgagatcgctccactgcactccagcctaggcaacagaaggagactctgtctcaaaacaaacaaacaaacaaacaaacaaacaaacaaacctggacgtggtggcacgtgcctgtagtcccagcaacttgggaggctgaggtgggaggatcacttgacctgggaggtaaaggctgcagtgagctgagattgtgccactgcactccagactctgtctcaaaaaaaaaaaaaaaaaggtagaataagggagtaaaaccaaaatttgagatttgaggtttggaaggagccagtcaagaagattcctagcccttggtctaaagtgtattcatatagtggaatgaggatgacagtagaaatctgacaaatttccaagtttgcagcctgtttttcatgatggcagagacatcagagaggtttctgggaacatatgtacaccagttgcttctgatcatttcacaggtgccccctcgagaagccaagatcatgtcctatgccagttgattatgaaggatcactctgcttgcagaagtacttatcatcctttggcaatgatggtggtggttttggtaagattgtccatagtcatggttatttcatgtagcagaacatggaacatggaggagttccagtgaactgagtggcccacacagcagtggctctaggcattaaagttgcccatacatgatctgttgcagcaatcaagatttttttggtttattcccaatctcttagcctcttgttctaagccttcttgaaaacctgatgagaaaggaaggtcacagcctccctctagggctggggttctttctgcctaaacttgtaacatgtttccatagaccctttggctcatctagtgtctggaaaactttggatgtaatagagtagttgaggtgagagaataagccagtctggttaagcatagattgtccttttcgaaaagtttgaagttgaaaaaagcttccttttgaagacttggaaacaaccaaatgcccatcagtgatagactggataaagaaaatgtggcacatatacaccatggattactgtgcagccataaaaaagaatgagttcatgtcctttgcagggaaatgaatgaagctggaagccattattctcagcaaactaacacaggaacagaaaaccaaacaccacatgttctcactcataagtaggagttgaacaatgagaacacatggacacagggaagggaacattacacaccagggcctgtccaggggtgagaggcaaggggagggagagcattaagccaaatacctaatgcatgcggggcttaaaacctagatgatgggttgataggtgcagcaaaccaccacggcacacatatactatgtaacaaacctacacgttctgcacatgtatcccagaactttaagtaaaattaaaaaaatttttaaaaaggtgctgtggagaaaagctaaaggaacctgagtgatagcaaaaggatgcctttaaatctgagacaggtataggaacttagggaaaactgcaggctgccaaagggaaggaaacacacagcctgcaatgaaaagcagggttgtgagactgaggttgagatgagttgaatgaatgaatgtcttagattctggggtccttgcagagatggtggaattgttaagagggagaataacttgggtgaagaggaagaggagattacacaaagcaaccctcatcatggaaaactgcagttgcaatggaggaagttatgcagagagtgaaggtgatgctggaggggacagagaaaaaagaggacacagcaaaggacagtaaaaagggtaagaataggacgttggcaaagaaatcctacagggtaatgttccagcatcttgggtggaaattaaccacctcgtgatgtcatctacttggtctgaagttcttgggagagctgtctacctcaagacactgtttcttgggactctcaagacagcctcagtttaaagtctctggttggggcagatttccatttagagtagcttttaatatattttcagttgagaaacatcaatccagggttacaccttccaggttttggcagcagtgtttttattattattattattatactttaagttttagggtacatgtgcacaatgtgcaggttagttacatatgtatacatgtggcatgctggtgtgctgcacccattaactcatcatttagcattaggtatatctcccaatgctatccctccccactccccccaccccacaacagtccccagagtgtgatgttccccttcctgtgtccatgtgttctcattgttcaattcccacctatgagtgagaacatgtggtgtttggttttttgcccttgcaatagtttactgagaatgatgatttccaatttcatccatgtccctacaaaggacatgaactcatcattttttatggctgcatagtattccatggcgtatatgtgccacattttcttaatccagtctatcattgttggacatttgggttggttccatctttgctattgtgaatagtgtcgcaataaacatacatgtgcatgtgtctttatagcagcatgatttataatcctttgggtatatacccagtaatgggatggctgggtcaaatggtatttctagttctagatccctgaggaatcaccacactgacttccacaagggttgaactagtttacagtcccaccaacagtgtaagtgtcctatttctccacatcctctccagcatctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagttctgttcatgtcctttgcccactttttgatgggattgtttgtttttttcttgcaaatttgtttgagttcattgtagattctggatattagccctttgccagatgagtaggttgcgaaaattttctcccattttataggttgcctgttcactctggtggtagtttcttttgctgtgcagacgctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttctattgatctatatctctgttttggtaccagtaccatgctgttttggttgctgtagccttggcagcagtgttagtgatgtacagaggacaatgcagaggcccttttaacagggtttaagattagttttctggtgatgttgactttagagaacaaggtctccaatttctaggttgtacaatggtttggataggaaaattggaggaaaatcagcctcaacctattgaaggtaagtttgagtataattgataaatattttgaagtaatttagattgtctgaattgaccaggttaggatatttgaaagcctaaatagaatagggaattctcatggggcttgccagttattattgtatatgggtatagtttgtgtgatctggcaggagaggatcagaaggcaatcagggctaagggtaaaattttaggccattgcgtattgagtttttccatcagtttagcaagctttattgtttgtttggtttggttttgttttttttacagataggatctcactatgttgctcaggctggtctcaaattcctgggctcaagcaatcctcccacctcagcctcccaagtagctgggaccataggcatgtgccaccacacccagctaatttttaattgttttttttgtagagatgggatcttgcttt[138 bp omitted]tattacaggaaagataggtgataagggatgatccggagagataataaggactacatatttttgtgatacaggaagaacgacttggatttcttagattactttactggtgaaatgggtccctcagccacttaaaaagagctaatggaattgtccatgtgcaaaacacttgccctgttaatttagggaaggctaagtattttttttacaacacttcccatacactttatataatattaactaaatctaattattttagtacctccttttaaaaagtgaaagaacaaatcattttgtgatttccttgggaccctctggaaaatctcaaaggcaggtttaggtataaaacataccatttaatattagatttggagctggtcgcagtggctcatgcctataaccccagcactttgggaggccgagaccagcggatcacttgaggtcaggagtttgagaccagcctggccaacatggtgaaaccccgtctctacttaaaaaatacaaaaattagccaggcatggtggcacacacctataattccagctactcgggaggctgaggcacgaaaatcgcttgaacccgggaggcagaggttgcagcgaccggagatggagccaccgcactccagcctgggcgacagattgagactctgtctcaaaaagaaaaaagaaaaaagattagatttgaggaaggcaaaatgtcaaaaattgttaggatacttgaaaatttggttaaatagggtcatgggtcactgataaacaatacttggctaccatttaactaaagtgattttaaagtaaatataggaggtaacatggttgtaaaaatagctctttaaaaagtgaaaaaacttgattctcttaaataactaaggatatgaaaaagtcaacataaagcacaggtataaagagctgggtgtcctctaattcaatccactactgactatctacttgagacagagtcagctcccacaagttgaggactcagtctcacaagactgtctcccatttgagatgccagttgcaagcacatattgagacctgtacttcttaccaactggctgtaagtcaggattcccacgacccccctgaggttcaattcatttgctagagcagctcacagaacccaggcaaacactttacttatgtttactggtttattaataagggatataatgaaggatgaagattaacagccagatagcgaagatgcatagagcaaggcatgagggaaggggtgtggagttcccatgccgcctccagagcaccaccctccaagaacccacacatttccagctatctggaagctccccaagccctgtccttttgggtttttatagaggctccattacctagatgtaattgattacatcattagccattgatgatcaattcaaccttcagccccagagttgagggatggggctggaggtcccaaccttctaatcacatggttgattcccctggcaaccagctcccatcctgaggctatccaggaggacattaagaggtcacctcattagagcaaaagatgcttctatcacccaggaaattccaagggatttagaagctctgtgtcagacactcctatcacacaagaaattacaacggtcttaagagctttgtatcagaaactggggtcaaagaccaaatattaaaacagaatatttttatcatctctctctcctgtaatgatagacagacctaacggactattaaaattaaagcttgctaaactggacatagtggcttacgcctgtaatcccagcactttgggaggtcaaggcaccaggagttcaagaccagcttgagcaacatagtgagaccccatctgtaaaagacaaaactaaaccaaaaacaaacaaacaataaagcttagtaaactgatggaaaaactcaatctccaatgaactaaagttttaccctctctgggactctccttcaccatctgtaaaatgaagccagggctcatttacgtgggattcccatgaggatcaagtaaaactgtgctggaagactttagcacaacacattcctgtctggcagcagaaggggatcagccttgaggtataaaattctgggttgcaatcagtggtgtgctgataacagctggccccagcgaaatggcacaagccagctcagcatggctcgatttatgtgaagtttctagaagaggctaaactaatctatggtgagaaaagtcaggacaatgcttgcctctggagggggtggcagcagggattgataaggaaagggcatgagggaactgtctcaggtgatggtcgtgtttaatgttttgataggggtttacatttgtcaaaattctttgaatgatacacttgagatttatacatttcactgtatacaattttacttaaaactgtaaatattgaactctagttaatgatatgtacgctgaattatctagaagcgaagtgcactgaaatctgcaacttactttgaattgcaccaaaaaataacatggattgatggacagatagaaacatggatagatgaaaagagatgagataaagccaggttaacaacatgtaacagtctgggtgtagggtatattggcacttaccaaacaattctttgtatcttctgtatgcttgaagatttaattatgaaaaatgttgaggaaacatactgagcatatcttacatacaaagttgtttatctttgccccattgcttctagtagtttcatttacatatattgattataattttatccactaatgacttttactttgcagagaaaactaggaagtagataactatgaactgtctatcatagagcaggctagcaaagcttatgaatatatatctcacaatctagttgatacaatattggcttattcgactagtaaacctgtacacatttaggaagaacataccaagtagaaagaagtgtatacttctgttatacttaatggtaataactcataaaacatagctatttttattaagccaacaatattaagctaattttgtttgccaaagatttacctaaattaggtaacttgaattttttttttttagatgaatttccttcttgttgcccaggctggagtgcagtggtgtgctcatggctcaccgcaacttccgcctcctgggttcaagcgattctcctgcctcagcctcccgagtagctgggattataggcatgcaccaccacgcccggctaattttgtatttttagtaaagatggagtttcaccacgttgaccaggctggtcttgaactcctgacctcaggtgatccacccgccttagcctcccaaagtgctgggattacaggtgtgagccaccacgcccggcagtaaattgaatttttaaaacatttatgttaggttttagagaatactttttcccccacactggaagtattagaagttcagattttttttttctgacagttttagggtttttaaggaattttataaattaatttgatagtatcatccagaggtagaaaaatatcacatatgcataaaataaatacataaacatacaggcagatgcaaataaagatcttacaggtttcattctaaaattttagccacgattcaggcataaacacagaaatacaaaactcactagtcaatacaacagagttggctcattgtctttgccccactttgtatttttatcagaattctgtttctggcagacgggacaagttgaggtttacctattcaacatgagggctaaagcttcccatcaatatttctggaggagaccttttttttcttttcttttttttttttttttttttgagacggagtctcactctgttgtccaggctggagtgctggagtgcagtggcgtgatctcggctcactgcaagctccgcctcctgggttcatgccattctcctgcctcagcctccccagtagctgggactacaggcgcccgccact[131 bp omitted]caccgcgcccggcatggaggagacttttaagattttctttgccctgatgtgtaatttgatggatgttgtggaccaaatgtttggtgagggactgaacagacacccagcagccatctgggtatctccaaagaccatctgagtagctaaaatatccagtctgtttccagctagctttcagcctctgatgcttgcttttggagcctctgaacccctcaagagtccccctgtggtggcagaaggaccaaagcgctaatgactatagggagttgaggtactggtttgagaagggaaaggtctggcaggggtagacagagaggtggaggaggtaggtatatgaatggggacaacatcaaaggatcccaggaaactgaaaggaagatcaaaggtggtaagggaaggaaggaggagtagaggccatgggaagggaaaggtcttagatgagctaatctggggagatcgcaagttccctaaagaggctactgaagttccaaattccctctggtaattttttggccatttatgaatacattagactgaatcagtgccccagcgggaagacatgtagtaaacaggaaagaagaggagggaaggcatctgagagaatgagttccccatgggattaacagatagttaagccaagattgaagagccaagggaacacttcatgtaatctccatggcagaaagcccagagaactcccacgcacaatttctggggtggagtcaagtgaaccccctgccccatgcaatcaccagggattgaggagctgaggaaattcccacacgccatccccatgtttgagatgccaagaaaattcttatgcataatcccccagtttagagagccaagaaaaaaacagaagaggcttcacagaaagggataaagaaatcactttgccagaaagaataaacgtaactcctgactaccacattacagcagataaacgtccaaagcactggattagataaggaagtgtgactcaccaccatggattcctacttttccaggcagaaaaagacacaaagggtccaggaagccagcatgaatacctgggtgaagacacaggttccgaggaacagccagcactccatctgagtcacagcgccattagtattcaaagaaacacaaatcaggatttagtaaggagagattttatttaaaaggattattacaagggagggaaaaggactattgaaatagggagaggaggatgactgcaatagggagaatgctgtgactataaggtctgcaagattctcaaagccaaacagaaaaaggtttttcttttatagaggaaggaggaagcaagcagggataaataatctttggaaaggaagctggacaagcaaggggcatgccctgggtctttgtgtttgggtttaaggacaagcagagggtaagcaatgggcaactgtgaacccttgatcggggcagatgacactctccaaggcttatagctagccaggtgcaccaaagggacaaacaaatcacagtcttctccctttctgatcttttctcctggctttcccccactaaatgggcagactggctgcaaactggctgaaatcttagtttgtggcctataagaccaagaatcttatacaactcttataggttgctttatcactgacaccaaaatcagttattatgaaataacatacaactaagattataaagccacctgggtccagggcatggatttttatttttatgtatttagttattcattgagacatggtctctctgtcacccaggctggagtgcagtggcacaatcatagctcactgcacctacgtcacccaagctggtctcaaattcctggcctcaagcaatcctctcaacgtgctgggattacaggtatgagccaccgtgcccggcccaggatggtttttttcatatataaatgagccaaacatgacctctatgtgttgggaaaagggcgggggtgcctgtataaacagatacacaatgccaatttatgcaggcaccccacaagcccttttcccaatgtcaatgtattaacccctaggttatttcttccctgcaggctgagatccattagttcaaatgcccaccagtgccaaacttaaatatttgcacatccaattatttttatttttattttttatttgagacagagtcttgctgtgtagccaggctggagcacaatggctcgatctcggctcactgcaacctccacctcccaggttcaagcgattctcctgcttcagcctcctgagtagctaggactacaggtgctcaccaccacgcccagctaatttttgtgtttttagtagagatggggtttcatcagttggccaggatggtctcgatctcttgacctcgtgatccgccctcctgagcctcccaaagtgctgggattacgggtgtaaaccaccgcgcccagctcagattattttttaaactagaccaaagaggcagactttttagcaatttacatcctgcctgttttgcatactccacaaaatctcaccccacatctgttgacaatagataagccctgggccataaagaccccaagcctctgctgcccttctgagctctctgacccaataactccacactgcgggctgagcaacatcacctagacacgtaagtcccctctctgacccccatctcccctaagaattccttgccttccttcccttctgagtaacctctatacagactcctgctgtgagggacttctgccacatacaagctgtcgatgcaccacccactaaagttgtgtatgctactgccacctcatgataatatcattcctccatcagtccccaaatccctcaaacctcctacatctctggcaaaattggagttgacagtgaatacagctgtattacctagtggtaaaatattaatagctcagtagttctgtacctatgtaaccctacccccatatgaatgggaatggactgagggggaagcacttgctagattggcattactgacagaaatctgagtcagtacagtgactgaacctaacatcctttccaaaggccaaaatgtttggatagaaataattgacaaatggagagaagaagaaatatggtagttcaggggaaatgaataaataaatggtttatgcaataggggaaatccagtattacattggtgcctcgagagaggctcagatcaagagaattatattgccttctagcacgattatgccagatccctgaaaggtgaggccatatgtctgctgaaactacttctctttttggaacctgacaaggttgaatggaagcctgcaaacctgagtaacatcattctgggagacattttgggtacatcatatgatgatgaactggaccaattgttgatgactgagtgaaactctacatgacagtatctttagactcttgtcaaaagtatattatttggggccaggcacagtggctcatgcctgtaatcccagaactttgggaggctgaggggggcggatcacctgaagtcaggagttcaagaccagcctggctaacatggagaaaccctgtctctactaaaaatacaaaaattagcctggcatctggcaggtgcctgtaatcccagctactcaggagggctgaggcaggagaatcacttggacctgggaggtggaggttacagtgagccaagatcgccaccactgcactccagcctgggtaacagagtgagactctgtctcaaaaaaaaaaggatatcatttgggaaggagtttctaggagctacaccctgccaggccatcggactgtgtggtgtaaaattccgagcagactgattactgtgtaactatagaccttaatgatagaatgcttagaaaggtccctggttttaagaggcaaaatatagcagtagcatgtctgacatgctacagttagccatgcacaaatgtatatcacctttgttttgtggacagaaagttatcaggttgatgcaaaagtaattgcagttttacattacattaaaagtcatggcaaaaaccgcagttactttcgcaccaacctaatattaaccagaatagaaaaaacaatgggtttcagatgggattaaagcagtagacatcaggtggtaggctcaaattccctagggaaatgccccaccctgaaatgaggaaggccatgtgagactttatgtcatgcccagactaaattacatctagatgtgattaccactcatctaaccctgttatgggggtcccaacattttgggatacacaacatgtgtcctagctgcactcaggccagcagtgcacaatggcaacaacatgcatagtggattaaacaacattgaccacagaacagaaaagagctttaggggagatagatgctggtctagggattgtgggacaagttcaatttgcttttaaggagaagcagcattcagaggaaaagatgtattaattagaataagtagactagagagattctcttccaggagaaagacaaaggatgagtgtcagcctgggataacaaagctttagtgaagtggggcaggcagactcaacaaataatgctgggtaatgctaggatccagtattgggaaagggtttgtacccagacccagcaaggcctcttgactattttaatacagatggaggctgaaatggccataaggactcctgtgtcctccccacagaagggagatgggccctaatttataacagcacataatggaaatcagtctcagtctcagtacaagcctgtggattgagatagatggtgggttttgtcctcaattgtcttagaacccagaaataaccaagaatcaagttgtagctcatcgtaataatacttgacaggaataatatctggtatatgcacaagtgctgattctgttaggaaggcttagcaaatacctctataattcttactgacttgaatcatactctgaccatactgtgatagggtgtaacactggcattgttagtaagattaaattgccttatataaataactcatgtgataatacagatattaataatcaaatttattggaagattgagttaaagcttattcaggatgtaatactggtggggaatcactagtccgaggaagaactagatttagctagccatcagctaatgtttatcctaaatagttctgtacagatttatcataaggtacaaatagcagtagatcgagagggtaaatgaataatcaaattagaccatgcacagtggctcatgcctgtaaccccagcactttgggaggctgaggctggtggatcatctgagcccaggacgcagaggttgcagtgagccaagattgtgccagtgcactccagtctgggtaatagagcaagactgtgtctcaaaataaataaataatcaaattagtatgaaatgtaatggttttgtaagatggattagttgtttctttaaatctacccctaccctacactggctcttccaaatgttaggaatatgcaaactgatactatcgctgtgtctggtatatgctgtgttaaatactacactaaatgtagatgctcaaacaaattttatcattttgctgtaataaaacctaggccaagggccagaagagtggactatgcagtaaagtgttaactcagcaggcctaggctgcccaaaccctgcacattccaaatgtctttagaattgaccctggaccaactcctaaaaataatctctgagcccttggaatatcttgcctgataagagtgtctttgtatacctgaaaccttggggcaagacaaatagtttatgctaacaatgtgatctatgtgaatgcctatttttgtatgcttgggattttgggtcacactgtatcagtttgacctctggcgagctggggtctaaatggctaaggtcaagtcatatgcattctgagcctacagaactggccctcaataaaaaaccctagacgtcaaggctcaggtgagtttccctggttggctatactttatatgtgttgtcacatatcattgctgggaaaattaagtgctattcacttgactctactcagaaaggataaccggaagcttctgcctggtttctcctcaactctgctctatgcacctttttcctttgctggtttaatctgtatctttagctataataaaccataaccatgaatagaaccattcttctgagttctgtgagttcttctagtgaattatcaagtctgagagtggtttaggggacccccaacacagtattccctactaggttttccacgaaacaaacaaaatagaaaaaagaaaacaattgaaaaacatgcatcagagaaatttagagagaataaagagattaataagttcgagaccagcccagccaacaagttcaagaccagcctggccaacatggtgaaaccccatctctactaaaaaatgcaaaaattagccgagcgtggtagaaggcacctataaacccagctactcaggaggctgagacaggacaattgcttgaacctgggaggtggagg[133 bp omitted]cacatttgtctgtgaaaagggcaaacatcatcagctacatgatttcattctccataaagagaaaataggtcaacttcttaggaagtaaaaatttccaggccaggtgtggtggctcatgcctgtaatcccagcattttgggagacctaggcaggcggatcacctgaggtcaggtgttagagactaccccatctctattaaaaatacaaaaaattagccgggtgtggtggcatgcacctgtaatcccagctactcaggaggctgaggtaggagaaccgcttgaacctgggaggtggaggttgcagtgagccaagattgactcactgcactccagcctgggcaacagagtgagactccatcttaaaaaaaaaaaaaaaaaagcaaaaacaaacaaacaaaaaaaacaacccccccccaaaaaaaacaggcacttaggcctaataaatgttattgttgattctttctaaaggtcagtagtgattttcagctcaggactctctcaatgaaactgtttttaaatttttctggtagatgcttgcagagcagagagtgggatttcctggttttctatggcttctttgctgttgtctctgtatgtgagttcatacccaactcaaggcaaattccttctcctatactcttccactagaaaagtctttattattattttctccctacaaatatgatctacatgtggagcaaaatatgtaaacaacataaatacgtaaacactaggaaaggaaaagcctctataaatggacaaggaaaatcctccataatctaacttctgactcccaactcaacctaaccatgattatctggcttgaaataaagcctaacaggctttatttactacgcatataatcctgtctatctgtgtgttgttttgtgtaaaatgagtgtgctgttcattatattctgtattttccttgacaaaaaaaatctgctatatactgtgtcttgcaatttgcttcgttcatggtagatttcagcataatttgaaaaaaaaagtttataaaggaaaacctaccaatcttctctcttatgaaatctagattttctgtaatgctttaaaagggcttccccacaaagaatttataagcaaaagattatcttgtttctcttgtgtttctcttattacttttacagtttcaatatgttaggtttaaatttttgtcatgtggaactttttatgtaaggtttcttcttttactaaggaaagagaccaccacttcccctgctgccttcctctccccttgtcttgcctagtttataagacaagaggaaagggagaaaacaaaaagttggaaagaaacaaaagtaagataaatggccagacgaccttggcaccaccatctggccttggtggttaaaaataataatcatcacgttctccatggttgcctgatctttcatgaccctttcacgtggaccctttagagttgtaagcccttaaaaaggccttttttcttttttgaggagctcagctctcaagacgtaagtctgccgaagctcccagccgaataaagcccccttacttctttaacccggtgtctgaggagttttgtctgtggctcgtcctgctacattacaacttctgtagtttctggatttttaaaatgtttacctttttgttacatctggaatttatttcatgtatggtatgaaataggtagaaggcccagtgggtaaggctccaactatttttttctgatggctactcagtattgaataatctttcttccaggtacatgaaatgtcactgtattagtctgttctcacactgctatgaagaaatacccaagattgggtagtttataaaggaaagaggttcaattgactctgcagcgctggggaggcctcaggaaacttacaatcatggcagaagggaaagcaaacacatccttctttgcatggcagcagcaaggaggagtgcagcgtggaggggaaagccccttataaaaccatcagatctcatgagaactcactatcatgaaaacagcatggaggtaaccgcccccatgattcaattacctcctaccaggtccctcccactacacatggggattatgtgaactacacctcaagatgagatttgggtgggaacacagccaaaccatatcagtcacttatgtttgtaaattctcacttgtattttgttctctttctggtctctattctctttcaatgactactctgctaatggcatttataaaggaaagaggttcaattgactctgcagtgctaatggcagagtagtcattccctaacagcctcagaaaaaaactagcccttccaaaaccttgattttagacttctggcctccagaactgtgagataatacatttctatcttttaaacaactcagtctatggtactttattatggcagccctagcaaacaagcacaccttcttttgttactttaaatgtgtactttttttttttttgagacatagtctcactctgtcatccaggctggagtacaatcatggctcactgcagccttaacttctgaggttcaagcaatcctcctacctcagcctcctgagtagctaggactacaggtgcataccaccaggcctggctaatttttttatttttcatagagatggggtctcattatgttatccagtctgatcttgaactcctggcctcaagtcatcctctcaccttggcctcccaaagtgctgggattacaggtgtgagccaccatacccagcctatactaaacggtctatgtctaataacttctatatctgaagttgtataggtttgactgtcgttttttatgaatcttgctaatagtgttttgtgtcttgttatcttgtgtgcactatgagtttttacactgtgggttcctatattttgaaattttatctgtgggttgaaaggtggcttacaccaaagtggatttatgtttacttctctcaggcatcttgggtcactacaacctgggaccatttcaagtaaatccttgaggtgttttgctgatacactggagatgtgacttgaggctgcaaagaagcatgatggcagctaatcctctggctcagggcttttgtacttgctattccctctgcctggcatgacctacttcaaatcctccttcacttcctttggatctctgctcaaatggcaccctattattgagaccttccctgcccaccccacatccacaggtgattccttgttcccctatcttgatttactttcattcatcaccagaggatgaatacttatacatacagacacacacatgcacacaacagaaacgtataactatctatgtatcacctttttattatccatgtccccacaaagcaggaa[137 bp omitted]tggtgaaaccccgtctccactaaaatacaaaaaaattagccaggcatggtggcgtgcacccgtagtcccagctacgcagcaggctgaggcaggaaaatcgcttgaacccgggaggcagaggttgagatgagctgagatcatgccactgcactccagcctggagacagagagatactccgtctcaaaaaaaaaacaaaaaaaaaaaaaaaaaaaaaacaactcaatggggtctgccatgcagtacat[179 bp omitted]caggcatggtggcaggcgcctgtagtcccagctactcaggaggctgaggcaagagaatggcatgaacccgggatgcagagcttccagtgagctgagatcgcgcagctgcactccagcctgggtgacagagcaagactccgtctcaaaaacaagcagacaaacaaacaaaaaaacaatgtccatccacactctgggagatttttaggaaattcttcactgttcctgtggcttgctgcaaagcactgacttcacaggaaatcagaccgcagaagctcggccacagcaacctcaacaaaacagacactccactgtctgagtctgctcaggctgctataacaaagataccataaactgagtaacttataaacaacagaaatttctttattacgactctagaggctgacaaatccaatatcaaggtgccagcagatttggtgtctggcgagggcccatttatcattgatggcatctccttgatgtatcctcacatggtggaaggggcaaacaagctccgtcaggcctctattattaggtcactaatcccattcatgagggcagaacccttgagatcaaatcacctcccaaaggccccaccttctaatatcatcactttggtaattaggtttcaaaatatgaattttgggagtacacaaacgcatccactattgctaccccttcactttgagagtatctgccaaaccaagattactgaagctgcaattctcaagaacatggcctgctcaaggtgggtaaagactgctgacataaatctgggaacaaaaatggcttcagtttcagtgaaagaatgagcttgaaataaaaccacctctgcccaagggactgtgctatggtttgaatgtgtcccttccaaaattcagatgctgtcaatgtgctagtattaagatgggcctttaagaggtgattgggtcacaagggctgctccctccttaatggattaatgcccttttaaaagaagattcacgaagtgttcagttagctcactagcttattagcttgcccttctgccttctgccatgtgaggacatggcaagaaggccctcaccagcccaaatgctagtgtcttgatcttggacttcccaccctccacaatagtaggaaataaacttctatgcttcataaattaccaatattaggcattctgttgtagaggtacaaagtgaactgagataaacgataagggaatcatccatctaaaatcttggcactaagtggaaaggtaaaaatgccctctgaacatttatagccactggcctaccatcatgcttctttgcagcttaaactcccaccttccaggtattatgggttatcaagattaaggatatcaggattatgcttagcttcctgaaaacccactgggagactccctctctttgttataccctggaacaaaagtaacacatctaaaacagtacaagtgaaatcaggaccacaagatgaagggtcaaaagacaataaagcaatgaaaacaggatgcacaacaggaaatatgctgggagtcctaagaccaaatagatttgttatactgacaaacaaaattgggctgaacaacagaatttacctactgaaaaacagaatactctcagattggaccacaatgtctaaagtagttctcagattaagatacataatccaaatatacctataataaaccagaaagagtgagattaattgaattatacattaaactaaagaagttagaaaaagaaaaaaaattaaaagcagatggaaggattttagtgaaataaaagcataaatgcataattagaaaatagaaaaacggcaaaaaatgcatgaactgcaacacaggtgagggagagtaaaagaaataaaatattagcatttatttacctaattgagggaaaaaatcacaaatacactctatgagaactatgttggagaaataaccacagatataaaggaaattaatcatgagactactttacccaaaattatgcaaatatattaagaaccttgaggaaatacatgatttttaaaaattacaaagagtccatatttctacatctatatattgatatatcaatatctcaatctaaatgcatatataggtcaggtgctgtggctcatgcctgtaatcccagcactttgggaagccaaagtgggtggatcacctgaggtcaggagttcgagaccagccttgccaacatggtgaaaccccatctctactaaaaatacaaaaattagccgggcctggtggtgcatgcctataatcccagctactcgagagggcgaggcaggacaatcgctcaaacctaggaggtggaggttgcagtgagccaagatcacgccactgcactccagcctgggtaacagagcgagactccatctcaaaataaataaatacataaatgcatatataatctaaacagaaaaatatggaaaaaatagagaaagatgacaaagagatacccttcaaataatgcaccatgcccaaataaattcacaagagaattctataaagcatttaatgaccaaacaacaccaaagtagtgctaattcttccagatacatttattctgtgaagagggctgagacagtttgagggtgagcaaattgattccatatttgtggggttgaaaatattctgagggcctaagcagatcattctgtggaagggtaatcatgtatactgaggaacatattagtctattctacagttgagaagttgtcactatttctattcaatgtgagttttcccatagacaatgaggactgacttctgggaataggccttcccacaatcagcatatatacaaggtgtctttcctatatggattctgatgcccagtaaagtatacatgctggcagaatgccttcccacagtcactgcatctggagggtttctccccagtgtgtcttctctgatatgtaatcatctgtgatttccagaaaaaagtcattccagactcagcacattcaggggttttctccctaggatgagttttctgatgtataatgagtggagactttccacagaaggcctttccacattcactacattcatagggtttctctccagtatgacctctctgatgtagaatgagatgtgacttcagggaaaaggccctcccacactcagtacactcatagggtttctcccctgtgtgaactctcagatgaataatgaggagtgatttctgggagaaggttttgccacattcaccacactgataaggtttctcccctgtatgaattctctggtgtatgataagaggtgatttctgagagaaggattttccacattcagtacacatataaggtttctctccagtatgaagtctttgatggccagtgaggtgtgacttctgggaaaaggccttcccacagtcagtacacacataaggtttttctcctgtatgaattctttgatgtcctatgaggtgggactgttggcagaaagttttcccacattcaccacacttatagggcttctctccagtatgcgttctctgatgtataatgagctgtgttttccgagggaaggtcttcccacattcagtacattcatagggcttcttcccagtatgagttatctggtgtataaaaaggtgagacatctcacagaaggctttcctgcattcactgcattcaaagggcttctctctggtatgaactctctgatgtataattagatgtgacttctgggagaaagcttttggacactcaaaacactcatagggtttctctccagtatggactctctgatgaacagtgaaaggtgacttccgggagaatgctcttccatacttagtacattcatagggtttctccccagtatgaatcctctgatgcacaatgaggtgtgatttctcactgaaggctttcctacaatctccacatacatatggtttctctccagtatgaattctttgatgtataatgagctgtgacttcttgataaaggctttcccacacatactacaaacattgggtttctctctggcttgaaatttcttatactgaacatgggcttgcttatgactgagaactttttcacattgactatctccatagggctccattccagtatgaatgaagccttccttctcaggcacagaacaggaagcattatacttaggtggtctcccacatctaaatctcttagtggggttctttcttgcatagctcctgttataatttagtaagtctgaattagacttcaagctattttcacatgaatcaaacttatggaatttttgacttaaaggagcaaggtctgtgcaccgattgaacattttcccaaatgcactgtacttggaacccatctcatcagtcaatgtttcacgactgatgactgtgacctgcctcaaaactctgtcttgatttccttgatatctatccatctgattatcaatatgccagatttttaaaacagagtacaatgaattatcctttggggctctttctagtatctccctttgaaataaaagttctccagaaatgatctgctgggaagattcaaggcctttcactctgtctgaaggaagaagaaagagggaaaatcaaatacacacacacacacacacacacacacacacacacacacacacaaaacagttggcaatgaacagaggtactaggaaggtggctgttgtagaatgaatgttataaaggaggcctgataaattttaaggaagaaaaaaggtaacggatgtcagagatgtcaaggaagaagaagatgcccgcttgaccatgtacccaattctcacttacctgggtagatccaccttgacaactcactctctatgatccatgggtcctttccatgttccaacttaaagattacatctggttttatacctgaacaccctgttaagagaaaattgtagtggctttggccttggcagctcagaaattcatgaagagaagcacttgcaggggcctcccagcaaagttggatccttaactcacaccataacataaaaataaattctagatataacaaaagtataaacatgaaaaaccaaaactataaaagaacacactctattaaaggaatatcataaaggtcatggtattgacagcactaaaggaaggatgaggaggatttgattcattggtacacagggaatctgcccttacccacggagaccaggtgattataggtctccagcatcacatccctatgcagggtcttctgagcaggattcaactgctgccactcttcctgcgtgaagtccacagccacatcctcaaatgtcactggttcctataacagcacattcctgtacaatctgctcattctggtcatttttaccatagcagtacatgtaggatgcctactttgcactttgcccagcatactttatgagagaaacaatgtaaaaccctgccattagcaagaatagttagtggaacagaacagacagtctagaaatagatacaaataaaaatgggaaatttaatatataataaaggtagcattttaaacaggaatggaaaaacagactattcaaaactggagagctatcagaaaaaaattaactggattccctacctcacactatatacaaaaataaattcatgacaaaaatttaaatgaaaaaagagaaactataaaataaagacaggagaggttttaaaaaataatctttgagtggagaagactcttctaagcatgccccaaaacccagatgccacaaatgaaaacactgataaatgtgactactttatgtattacatggcaaaatatatcaaacaaactcaaaggatatgactaactagggaaaaaatatacacataacagataggatggacaaagagttaatttcctccatgtatagagagagctcctacaaagcaagaagaaaaagaccaataactttttaaaaaatggttgatatggtttgactctgtttccccacccaaatctcattttgaattgcaatccccacttgtcaagtgaaggaggtgattgaatcatggaggcagtttcccccatgctgttctcataatagtgagtgagttctcacaagatctaatggtattataagcgtctggcatttcccttgctggcacttctctctcctgccaccatgtgaagaaggtccttgcttccccttccaccatgattgtaagtttcctgaggcttccccacccccgtggaactgtgagtcaattaaacctctctcctttataaattacccagtcttgggtatttctttatagtgacatgagaacagactaatacgatggtcaagggacatgaccatcatttcacagaaaataaaatgcaaatgttttttaaacatgtaaaaagatgctcaacttcactcacatgaagataaatgcaaactaagacaagacagcatttttcccttacatattatcaaagatgggtgtttgataagtcactggtcaaatgctatgactagggataagtcacagtgacttagggtaagttagtgaagatgtcaagaagcaggcatactcaaattgtctgtggtgtatggtatattttgaaggcaattaatttggcaatatctatccaaatttataatgtatacatcctctgactcgcaatttggtttctagaagttattctacataaacatttacttatgtgagcaaatgacatgtgtgaagacactgctctacagtactatttataatagcaaaagaatggaaaccacctcatgggagattggatgaataaataatgctacaatctccataagggaatactatatgcaattataaaaagcaacaaagaaggggccagatgtggtggctcacgcctgtaatcccagcccttggggaggcaggggcaggtggatcacttgaggtcaggaattcaagaccagcctggccaacatggcgaaaccccgtctctactaaaaatacaaaaattagccgagcatggtggtgcatgcctgtagtcccagctactcaggcggctgaggcaggagacttgcttgaacccaggaggcggaggatgcagtgagccgagactgtgccactgcactcaagcctgggcgacagactgagactctgtctcaaaaacaaacaaacaaccagcctgggcaacatggcaaaaccctgtctctacaaaaaattagccgggtgtggtggcacacacctatagtcccagctactagggaggctgaggtgagaggattacctgagcctgggaggtcaagactgcagtgaggcaagatagtgccactgcactctagcctgggcaactggggtgaaaccctgtctcaaaaagaaagaaagaaagagagagagagagagagagagggagggagggagggagggaggaaggaaggaaggaaggcaggcaggcaggcaacaaggaagatctatattaattgatatgccacaatatctaagatacactgttaagtgaaaataaacattcattcactcagcaagcagttattgagtacctagcgaataccaagcactattctaggaactggggatacagcaggaaaaaaaacctggcaaaaataccttccctgaaggagtttgtattctagtgaggggagacagacaaaaaggttgagagaaaaatcactacctggccaaaaaaaaaaaaaaaaaagtttgcaatgtgcacttcaaaatcactcatatacaaaaagctcctgggaaaccataagcaaagacaaggaaagagggattcacagagaaatacaatatggaaaataaatatgtgaaaagatgctgaagcttatttaatccctatagaaaagcaaatgaaaatgagatataatgcttaatcataaaaacaacaagaatgaaaaaaacagatgatggctaatggtggcaggagggagggggaaccttgggaaacaggtgggctttcttgtaaacaatttgtggccacatgttcagctgattacacagtattgaaatacaatttgggctgggcagggtggctcatgcctgtaatcccagcactttgggaggccaaggtgggcagatcacttgaggtcaggagttcgagaccagcctgcccaacatggtgaaacccagtctctactaaaaatacaaaaattagccgggcgtggtggcaggcacttgtaatccctgctactcgggaggctgaggcatgagaatcgcttgaacctgggaggcggaggttacagtgagctgagatcatgccactgcactccaacctgggggacagagtgagactttgtctcaaaaaaatatatatatatacgatttgaaaaatactctttaaatttataagtctgtgtgcctctgacctagcacactcatgtctgagaatgtggcctacacaaatacttcacaaatataaaaagatatctttatatggttgttttatttgtgacttcactgcttgagaggtctggttaggtcatgtactagctgtgtgatctctgtgcctcattttcttcatctgaaaaatgggaataacaatggtacctagcacagagggttcctgggtgaattaaataagttaatcccacgatattttataatagcagtgcctggcacatgataagcactgagtaaatagtagctatgattcttcttattattattactactgtatataaaagaaaaactagaaataacttttttacagcccatcaacaaggttctggtatcctgcaaacattaaatggacatttaatggacattaatttgacaatgtacatcagtagacaatgtagatcaggacatagcaaactatagcctgcaggccaaatttagcccatcatgtgtttttcaatggcccacaagctaaactggttttacacgttttcttttgagacagtcttgctctatcagccaagctggagtacagtggaacagtcttgattcactgcaacctcctcctcccgggctcaagtgattctcctacatcagcctcctgagtagctgggaccacaggcgcatgccaccatgcctggttaatttttgtatttttttgtagagatgcggtttcgccatgctgcccaggctggtctagaactcctgagctcaagcaatccgcccaccttggcctcccaaagtgctgggattataggcgtgaatagctagctgtatctggtctggtttttacatttttaatgattgaaaaaaaagtcaaaagaagaatattttatgacacatgaaaattatatgaaatccaaccttcagcatccataaataaagtgttattgaatcacagccaggctcattggtttacatattgtcaatagctgctttctacctaaaacagcagatttgaatagttgcaacaggggccgtatggcccacaaagcctcagatacttcgatctgtccctctacagaaaaagtttgctgacccctgacttagaggaactggacaaattacttgaaaattacaatttaccaaaccagacataaaaagaaatagaaaatctgaatggtagtatatcttttaaataaattgaatatgtaatttaaaaccttcccacaaagaaaactccataccctgatggcttcactggggagctctttcaaacatttaagaaggaaataggccgggcgcagtggctcatgcctgtaatcccaacactttgggaggccgaggtgggtggatcacctgaggccaggaattcgagaccagcctgcccaacatggtgaaaccccatctctactaaaaatacaaaagttagcctgggaggtcaaggctgcagtgaggcaagatagtgccactgcactctagcctgggcaactggggtgaaaccctgtctcaaaaagaaagaaagaaagaaagaaagagagagagagagagagagagagggagggagggagggagggagggaggaaggaaggaaggaaggcaggcaggcacttgtaatcccagctacttggtggcgggcacttgtaatcccagctacttgggagactgaggcaggagaatcgcttgaacctgggaggcagaggttgcaatgagcggatatcgtgccattgcactccagcctgggcgacaagagtgaaactccatctcaaaaaaaaaaaaaatttaagatggaaatagtaccaatattacccaaattttcccagagaatataaagagaatactttccaacatgaggccaatgtaacatgataccaaaaggtgacagaaacaatagaagaaagtaaaattacaggcccttatgtcttatgaacacagtagtataaaccctaaacaaaatattaacaagggattggctagatcatgatgatgatgacgataggagtaggtggggatgaaagatagataaaacaagcttggttatcagttgataatatttgcagatgggtaattacaaaagggttcactaaaatctctactttcgtatatattttatattaggcaagaaaagaaagtagcagaacggaatagaaacagtgtgtgtattttttgtgtgtggtaaagaaaaaatacatgacaataatgagatcactttcacacatttacacatccatctacacacatagatggagttataaatgcataaagaaaagagatcctcctcaaaccagataatcctagttatgtcggggaaggaggaagaagtaagattggagatatttcacttcctttttttttttaaactatattgtttacattctttgccccatgtatagattaccttttcagggagaaaaaaaaaaacgactaaaattggaagagcagagaaggaactgccttgagttgggttgagaccccacaaactctgagatgacagcaaaggagccatggaaaacaaggaaactatcccactctccaagcccctgccagagaactttaactaaaaacagtctctttagaacaactactgacaataccaccctggactgaaaaccactgaccttcaggaaaactcagtaataaaattcctcaagttaaagtccaagaaatcttgacttgctaaggagctggactgatttctttttgtggagaatgcaaatcacattattgatcatgttatgttacccttttcactgaagctgccagtcaaaatgttttgcttatagtcaaaattttagctaagtttctatgaagtaaggccaggtgatctgtgtatcttcacagcaattttgcctgttgatcatctattctctctaaatttctctaatccttattttcaactaattgccctttctcattttgttgtgggaaaaccaagtggcaaacaaataacttacctgggactcaatcattttctgtttctctttggaaagcagttgggggcggggtggggtgcagaagagtcttcggagatcaagctgagttaaccactcttcaacagctggatgtgacaatgtgttgcttgttaattcattgatgacttgtgtttctcatctgactcggtaattccatttccggaacttcgtcctaaggtaataatcatggatatgtgcagatatttaaccacagaaaccttcaacacagttttgtctttaacaccatattattgaaaataacacaaatgcccagcactaaagactgctgcaaaggcaggcagcccttaaaagcaacactccagatgattcaaaaaggttcaggaaacaccaccagcaaatgtaaagtatggtcttgtctggctctttacttgaataaacaaaagaaatttttgagataatcatgaaagtttgaaccctgactagatatttgataacattaaggaatttaaccattgattatctgaagatattattgctaattattttaccttagggtaacagcatcaacctttaaggccttatctttttcataatgaagcatgtatggatgaaaatatgtgtctgggatttgtttcaaaataataaagactacccatgtaaaaagtcattgaactgcatacaggccgggtgcggtgggccagcacgttggaaggccaaggcgggtggattgcctgagctcaggaattggagaccagcctgagcaacatggcgaaccccatctctactaaaaaaatgcaaaaagcagccaggcgtggtggtgcatgcttgtaatcccagcatgttgggaggcggaggtgggcaaattgcttgagcccaggagttgaagaccagcctgggcaacatagggagacccatctctacaaaaaattagcctggcgtggcggtgcacagctgtaagcccagcactttgggaggctgaggcaggcagatggcttgagcccaggagttcgagaccaacctggtcaacatggcaaaattcgcctctactaaaaatacaaaaattagccaggcgtagtggtgggcgcctgtattcccagctactagggagactgagacatgagaatcacttgaacccaaggaggtggcatttgcagtgagccgagattgagccactgcacttcagcctgggcaacgagcgagtgaggaaagaggaaagaaaggcaagaaaggcaggaaggaaggcaggagggaaggcaggaaggaaggcaggacagaaggcaggaaggaaggcaggaaggaagggagggagggaggaagaaggaaggaaggaaggaaggaaggaaggaaagaaaagaaaagaaaagaaaaaagaaaagaaaagaaaagaaaagagggagggagggagagaggaaggaaggaaggaaggaaggaaggaaggaagaaagggaggaagggcattccgggaggaagaagtgagggggtggcctagatgaggacttggcaaactttttctgtaaaagggtcatatggtaaatgttttcaattttgtgggttctgtggtctctgctgtaactactcagccctgccattgcaggttgaaagtagccctagacaatacataaactaaaggtgttcactggctgtgttccaattaaacatcatttttgggcactgacatttgaattttatatcattttcatgggtcacaaaatattctccatttgatttttttccaatgataaaaagtgtgaaaaaaccatttcttagctcatggctgtattttttttttaaaaagcaacatgtcatatttggcccactgcccagttttccagcccctggtctagataaaacaagatgggccatgagctgatgactgatgagactgggtggtgggcataatggggttccattatacaattccctctatttttgtggatgcttgaaaatttccataagaaaggtttatagttaagtattaccatagaaataaaccaagtcgtactacgggaattaagttaatggcatggaaacatcactgtaaaatgaagaagaggcagaacacaagaatgtattcctaattgtttaataacagaataacaggccaggggtggtggctcacacctgtcatcccagtactttgggaggccaaggcaagaggattgcttgagtccaggagttcgaggccagcctgagcaacatagtgagacctcgtttctacaaaaaataaacaaaattagccgggcgtggtggtgcacacctgtagtcccggctacttggcaggctgaggcaggagagtcacttgaacccgggaggcggaggttgcaatgtgctgagatcacgccattgcactccagcctgggcaacagaatgagaccctgtcaaagaaaaaaaaaaaggaaaagaaaagaaaacaaaaaaaaaataccatgtagatcacacattctcactggggggtgatactgcccccaaggggacaaaaattagttcttggaggcaaaacaaaacaaaacaaaacaaaaacaaaaaaaagcttcttagatattacaatgggttgtgaccctccaaagcaaccctagctgacaaaaccttattccttggtatttaatttccttcaccagattttggtattacatgagcagcagtaaccttgagttcaaggaagatccatgaaatatatacaaaattagtgctgcaaaactatggcgaataggtaacattcaggtattaactcacttctcatcccaagcctcacagggtaggccctgctattatcctcatttcgcagtgggaaactgatgcctagagaggtttcatgagttgtctaagatcacactgccagtgatttagagcgaggtggtagaggaacaaaaagtaaagaactcctcccaagctgtcctagcactaagattttcaggcaacaccccttgcttctggatgccctaaaaaattagttatcctcctaaattccacaggaca[144 bp omitted]gcctccccagtagctgggactacaggagcccgccaccacgcccagctaatttttttgtaattttagtagagacggggtttcaccgtgttagccaggatggtctcgatttcctgacctcgtgatccggccgcctcggcctcccaaagtgctgggattataggtgtgagccaccacgcccagccgatattgtctgctttttaactgaagaatgtgctttacagttcaaaattaactgaaaatcttcatatttaaagccataaaatgaaaagagaagccaaaagctggaaggagatatttgcaaaacacataccactactaaaggag[131 bp omitted]cgaaaccctgtctctactacaaatacaaaaaaatcagccaggcgtggtggcaggcgcctgtaattccagctactcgggaggctgaggtaggataattgctagaacccaggaggtggaggttgcagtgaaccatgatttctccactgcactccagcctgggcgacagagtgagacttcgtctaaaaaaaaaaaaaaaaaaaaattcctacaaatcattaagaaaagggcagagagtccaacagaaaaatgaacaaaagacaggcccctcacaaaagaagatctccaagtgatgaatccatataagaaaatgtgctcaaacttattggtcatgagggaaatacaaatcaaaccaccaagttggacttctccatcggaatgtggacaccacatgttcattcatgcacatatgattgatctgaaaaagccacccatcatggaccccacagaatgtcaacactgaccccacacacactcccattcttgtcctcatagaccctcatccctcaccccagatccccctatccactcaccccacggatcagcatccctcaccctacagaccacccatcactcaccccagactcccttcacccatcccatagaagccccatcactcacccttacagacatcatcaaacaccgcacagatcccccatcaccccacaaactcccatttgcataacccacatactgttacccctggtcccacaggctcccctatcactgttctccacgtcactcaatcccctcctcaggccctccacttgtctccatccgtcactgatcacatagacccgcagcactcagccaggcccctcaccccggctctgctctcaagccgggcttggctccccgcctgcccaaatgcgttcaacatcccccgaaaggccatttcccttccagtcttcccggagagatgtcagggtgacgagggagcttatctttcggtggctccgaaacagccacgaagccgagctctaccagtaacaaaaatggcgtcattccgccagcgccaggacctctgtcgctggccgtggtctcgcactgcttctggaggctcccattccagccagaggagaggtgcgtttgggggcccgggggagtcctcgtgatatctccgagtttgggtattcggaattgatcctacgaaagcagtgtgaggcttggaagggccgcgacttgtccgggtgagtgggcgttcccggccaccagaagaggcacggcctgagcaaaggcgtggcgacatggcagggtgggaaacggggaaagtgggaaggctggacagagcaccccccgggagattcctccgcagaagcgaattcctaaaacgtctggagaaagggaagagacctttgacatcatgcagcctttcagggggctcacacatacccgcccacttctccccacctggcctcggcgccctgccgccttcctattgttcctgcttggcgtcaggacccgcccccatctgtcactcactgcccaccggtcctccattggctcctttgaacacggaagggcccaccttcacctgtcatttacagcctggacttctgcctgccctagttcaagtaggcttatatggccttttgcagcccgtatcaaaactaaaagagttcatagagtcagaggttcgaggtaaaacctaagggacattggttttagacgacttaacaaagggctggattggaagtcagcccggaacaggattgcagagttaacaaaggttcatgttcgatacaaaacgggaactctgatggttacaatagttaagaaagtcctaggattcaagacctctatcagggtgtatggatggagaaaacattaacaaatatcctgcttgaagatcaaatcagaggggcactggtggtgcaatagtaacccaattccaaagttatttcagagaggccttaaatggaaggttaacttagacccaaatctgagccaagaccagagacccattaaagtcacgtgatgtggttaacagagccccggaattcacagcctataccaaaggggtaatgatggtggaagaattaatcaaggtctgacttcaaagtcaaaccaaatggcattcatgataaaaatgttaactgagggctgggcacagtggctaacacttgcaatctcagaactttgggaggccaaggcgggaggatcacttgaggccaggagttagagaccagcctggccaacatggcaaaaccctatctctactaaaaatacaaaatttagccagatgtggtggcacatgcctgtagtctcagctgcttgggaggctgaggcatgagaatcgcttgaacctgggaggtggaggttgcagtgggccaagactgtgacactgcactccaacctgggggagagacaaaactctgtctcaaaaaataaaaataagaaaaaaatgttaactgagggccgggcacagtggctgacacctgtaatcccaggactttgggaggctgaggcgggaggatcatgtgagcccaggagatcaagaccagtctgggcaacatagtgagactccatctctataaaaataaatgttaactgaggattggggttggtggatacaggagaaggggcacaagtagctaaaaagttagtacagccttgattttctgtacataccaaaggatcatagatggagaggactcaactgaggcctgcagtcagtgtaaagatctgagggatgcagagcgtagtggctcactcctataatcccagcattttgggaggtggaggcaggcagatcacttgaagccaggactcagcatagccaacttggcgaaaacctgtctctactaaaaatacgaaaattacccagacgtggtggtgcatgcctgtaattccagctgcttgggtggccgaagcatgagaatcactagaacctgggaggtggaggttgcagtgagcaagaactgaggggcagtaatggggaaagagttaacagacatgcaaaaagattcacatgtaaattgccctggtgatggaaaagtgaacagaaactcaagcttaacacatagacccaggattattaattttccaccctcaaagccctgaattctctctctagatccaaacccattaatagtggaatggataacagattccccagttcaaggtaaaattaagggttgatttaggttggaagagttaatagaagcccaggttggagagcacagataagagactttgatggtggaattgctaacaacagctggggtttgaggtgaggtcagagggatagggatggtggaagagttaagaaggacatggtttgagtatagaccagacgggccatcaatgatggaatatttcaaagatgcctgtattcatttcctgttgttgctatagcaaattatcacagacttacttgctcaaaacaacacaaatttattatcttacagtcctacatgtcagaaatatgatatgggtttcactgggcactccctacagaggcttaggagaaactctgtttatttgctttacctagcttctgctagaagtcacctgtattccttgactcatggtcccttcctccatcttcaaagctgatagtgtagcatcttcacattgctctctgacggtaacctgcttccatcatcacgtctccttttctaactcaaacccttctccttccctgttttatatatatatggagagagagagagagagagagagagagagacagacagacagacaggatcttgctctgtcacccaggctggagtgctgtggtgtgatcagacactgtaacctttaacttcggggctcaagcgatcctctcacctccgcctctggagtagctaggactacaggcacatgccacca[131 bp omitted]cctcagcctccagagtagctaggactacaggtgcccgcctcaacgcccggctaattttttgtatttttagtagagacagggtttcacca[131 bp omitted]aggttgcccaggctggactccaattcctggcctcaagcaatcctcccaactcagcctcccagagcgctccctccctctatgaaggaggacccttgattacattgggcccatctagataatgtaaggacccttgattacattgggcccatctagataatccaggaaaatctcatcttaaaattcttaatcacatctgcaaagttccttttgctttgtaaggtaacatattcacaggttctaggggttgggagagggatatctttggggggactattaatctgtctaccacaatgcccaatgtttaagtcaaaccagagggccaatgggggcggaagatttgattgaagcatagggtattaacaagagaaaacgatcaatggtttgaatcagatttaagttcacataggatgggcctagatgaggggtccaggctgttacgtcagaattgcatcaagggcctgagttcaaagttaaaggaaattcaaagtcaaagttcaaatttcaaaggaaattgatggaatctcaacagagatcctgagctctggatcaaagccccaggagcactggtggttaaaaaaaaaaaaaaagtcaacagaggcccaggtttaagatctacaatatagacacattgatggtggaataattaacaggtttgagggtgggctgggtgcggtggctcatgcctgtaatcccaacactttggaaggccgaggtgggcggatgacaaggtcaagagatcaagaccatcctggccaacacgctgaaatcccgtctctactaaaaacacaaaaattagctgggcatggtggtgcactcctgtagtcccagctactcgggaggctgaggcaggagaattgcttgaatccaggaggcagaggttgcagtgagccgagatcatgccactgcactcccacctggtgacagagcgagactccatctcaaaaaacaaaacaaaacaaaacaaaacaaaaaatctgagggccattgatgattaacgacttaacagggctgggtgcagtggctcacacctgtaatcccagcactttgggaggctgaagcaggaggatcacttgagcccaggagttcaagaccaacctggacaacatagcaaaaacccatctctacaaataaaaaaacaattagctgggtgcagtggtacatgcctgtaatctcagctactccagaagctgaggcaggaggatcgcttgagcccaggacttcgaggctgcagtgggctatgattgtgatactgcacttcagcctgggtgacagagcaagacccctaaaaaaaaatttaacagccagccagattcaatgtcaaaaaatgggagcattaatgctaaaatctataactgagctctaggtttaatatataaatcagagtgggaaaactaatggtgttaagaaacctggatttaattcacagatcagaagaggcattgatggaggaaaaataaaaagaagtcaggtttggttttcatgctagaaatgagttgatgatgaaatagttaacagagatgccccaacaagtggggcattaggggtggaagcattaacagaagtaggcataaagagaaaactgaacagtccaggcacagtggctcacgcctgtaatcccaacactttgggaggctgaggcagatcacttgaggtcaggagtttgagaccagcctggccaacatggggaaaccccatctctattaaaaatacaaaaattagctaggcgtggtggcacatgcctgtaatcctaggtactcaggaggctgaggcataagaatcacttgaaaccgggagggggaggttgcagtgagcagagatcacaccactgcactccagcctgggcaacagagtggaactccatctcaaaaaaaaaagaaagaaagaaagagagaaaactgaacagagaaccaggtgcaaggtcaggcctgagtggcagtgaaagtggaagagttaacacaggaccaagatcaaggctcagatctgaaggccatagatggcagaaatgtgacccaaggcctagattcagtgtggagaagagaggacacataatctgctgtgtagccctaactaaagccacaatcatgtctagacttcatcagtgttatgcagtagctgctgtgcactgaattgtgttccctcaaaatttgtatgttgaagacctaacaccctacatgactgcatgggagatacggcctataagaagatgattaaggttaatgatgtcagaaggtggaaccctgattggagacaagtgtaagagacccaagagattctctctccgccatgtgatgacacagcatgaaggcagccatcggcaagccagaaagagaggcttcaccagaaaccaaacctttctggaaccttgatcttggactttccagcctccagaactgtgagaaaataaatttctattgtttaagccatctagtctatggtattttgttatggcaacctaagcagactaatacagtagctatgtacatctttaagatttctctcaaatatgtgggaaactatgtatgacaggacccctggaagttaagaattttcatgatgatcaaagcccttctcaataattttttgatgcttctctctagacatgtccacaggaatttttaaaaataaaatgtttaggcagagcacagtggctcaggcctataattccaactctttgggagcccagggcaggaggatagcgtgagcccaggaattggagaccagcctgggcaacctagtgagatcccatctctacaaaaaatgtaaaaataataataataaaaaataaaataatctttacaaaaatttctgatgcagtaagtaatgcctttcatgcatactcctggactctagacccagagcttctgatccaataagtcaaggatgaggtccaatactctgcatttattttaatgctttatttggaaataatttcaaacttacagaaaaagttgcaaaaatagtacaaagaactctcatatacccttcatccagattctccaaatgtgattattttatcctattttctttacatatatataacatatatgtacatatatatggtgcatattatatatatatatatatacacataattttttctgaatcatttaaatataaatgtctgttgcaggaagtcagggaccccaaacggagggactggctgaagccatggcagaagaacgtgaattgtgaagatttcatggacatttattagttccccaaattaatacttttataatttcttatgcctgtctttactgcaatctctaaacataaattgtaaatatttcatggacacttatcacttcttcaatcaatacccttgtgatttcctatgcctgtctttactttaatctcttaatcctgtcagctgaggaggatgtatgtcgcctcaggacaatatgataattgcgttaactgcacaaattgtacagcatgtatgtttgagcaatatgaaatgtgggcaccttgaaaaaagaacaggataacagcaattgttcggggaataagagagatagccttaaactctgaatgccggtgagccggatggaacagagccatatttctcttctttcaaaagcaaatgggagaaatatggctgaattccttttctcagcaaggaacatccctgagaaagagaatacgcacctggagatataggcctatgaacggcccccccaggtgcacctgtcttttatggtcaagactgcaggggtgaaataaaccccagtctcccatagcactcccaggcttattaggaagaggaaattcccacctaataattttggtcagaccggttgctctcaaaaccctgtctcctgataagatgttatcaatgactatggtgcccgaatcttcattagcaattttaatttcaccttggtcctgtggtcctgtgatctcgccctgcctccacttgccttgtgatattctattaccttgtaaagtacttgatgtctgtgacccacaccctattcgtatactccctccccttttgaaactccctaataaaaacttgctggtttaacggcttgtggggcatcacagaatctaccgacatgtgatgtctcccccggacgcccagctttaaaatttctctcttttgtactctgtccctttatttctcaagctggccgatgcttaaggaaaatagaaaagaacctatgtgaatatcggggtaggttccccaataaatgtcagcctggcaaggtggcttaggcctataattgcagcactttgggaagtcaaggtgggatgatcacttgaactaaggagttcgagacaagcctgggcaacatggcaaaatcccatctctaccaaaaatacaaaaaattagccaggtgtggtggcacacacctgtggtcccagctattcaggaggctgaggtggggggattgctggaacctgggaggtggaggatgcagtaagccgagatcatgcctctgtactccagtctgggcaacagagtgagactctgtctcaaaaaacaaacaaacagaaacaataaatgtccctaaatactagtgtgtttttgctaaagaaaaacagagaaaacaggacattgccttatataaccataatataataatcaaagtcaagaaattaacattgatacagcacaattatctaatctttaaacctttttgggctgggtgcggtggcttgagcctgtaatcccagcattttgggaggccgaggtgggtggatcacttgaggtcaggagttggagaccagcctggccaacgtggtgaaatcccatctctactaaaaatgcaaaacttagctgggtgtggtggtgggtgcctgtgatcccagctgcttgggaggctgagacaggagaattgcttgaacccgggaagcagagaggttgcagtgagccaagatcatgccattgctctccaggctgggtgacaagagtgaaactctgtctcaaaaaacaaaaacaaaaccttttcaaaatatgccaatagtcccaataatgttctttacagcaaaagacaactttttttctgttcctggatccagtctagattctgctttgcatttacctgtctcatctcttcagtctcccttaatctgtcctttcttcatcttttatgacattggccttttttgaaggacataggcaggttgttttgcagaatgtaccttgggttcatactgacatctctgattccagtccaaggtctcaggattattttagccctacctcctttccagatttgtaatgcctttctcagacagtgagaaacatggctctcattatctctattttactcatttgttcaatcctcatatacacataaagtagtctcagaattcctaaccatacccctgtgttaaaaaaaaaaatcactaactaaattacaaaatttggctgggcatggtggctcatgcctgtaatccgagcactttgggaggccgaggtgggaggaccacttgagcacaagagttaaagattagcctgagcaacatagggaaaccccatcactatttaaaaaataaaaataaaaaagtacaatatttgcatacagtcatttttgatttttgtcttatagtatccagtcaaaataactgtttcccaaagttactcagattagctattttcttcctcatgcccgttagcgtggttatgttattcatttgtaatatacttaggttcctttgtttctatttatgttccattttgggtccccccaagcctagtttattttaatgtatttattttttcacctacttcctcacttttctatatctatttttgcaatatgtgaaacactactatgcttttaaaagaggcaaaactataccaaaagaataaaagtgttcctccctgctcatccctacttcccatcccctcctttccaccatgttcctacccatcccctttaggtaaaaatctcgttcattattgtttcatgcgcaagctcaggatgaaagtgttgggccttgggaggtggattcccatgattccatgctccggttcccttctgcagtaaatgtatccaaaggcctgaccgtgcttcttagatttcctgggtgtaatgtattgaagagggtgggggaattcacctgagcgcatggttgtgggatcacccagaaattgaggagtttcactattttatttaatttagggtttaaaaagttaaagtgtgttccatatacctgcaagaaaacagccagtttatggcaaaaacggtgctatcttgaagcaaatccaccatcatgatcaacgtttgactcctgcataccgaagtgttctgcagcaaggtttttaaacagttcctgcagtatagataaccttaataataagcttatttaacctgcccagttttctttctcttttcttttcttttcttttttttcttttctttcctttctctctctctttctctctttctctctctttctttctttctttctccttccttccttccttccttccttccttccttcctttctttctttctttctttctttctttctttctttctttctttctttctttctttctttctttctttctttctttctttctttctctctttctttctcttccagagtctcgctctgtcacccaggctggagtgcagtggtgcgatcctggctcactgcaacctctgcctctcgggttcaagcaattctcctgcctcagcctccagagtagctgggattacaggtgcctgccacccacacctggctaatttttacatttttagtagagacagggtttcaccatgttggccaggctggtctcaaactcttgacctcaagtgatttgctcgcctcggcctcccagtgttgggattacaggtgtgagccactgtgcccggcctccccagttttccagagttttggcaagcaagtctaagaccagactggctggacgtgtctttactctaaaagcatgctatagaaagaatactttctgatgggcgggtgcggggttccaccctcttagagctccctgagatggcctgcattcctaagtccctattaaatattcctttctgagaactgggtttgtcagccttattcttctgcctttcagttcccttggcctttaggggtgggtttgcgtataccagctactgtggaacatttgctgagccaggcaggagctgaagaactaagaaattgatccttttgtagttcctaagcatgatgattgggtgttcatgtgcttatgtgagatgtgcctttctcaaaccttgttatgacatcagcacattattcatctgatatgaaaaaaaaaaaaagaaatgggtaaggggaatgaagcatctgtgcgtgaaactccagggtggccagcaacatctatgtggggtggtgtgacacctctgttagatgcttgtggacctccgcatgagtaatgggacatcccgaaaactcaaaaggagttattaactgaaagccatatagtgcactgcgatagggaagggtggtggataacctatccagtgggctggccacttctctgggctgttcatttggcattggaggcccagctagcagcagagatgaaaattaaatggctagggaaggaattgcaacaagaaaaagacacgtgacttttgacttttctccttgcatccaacataatgaagaaaattgacgaccaagagaacaaaaattgaaaccttagcatgtagatagattggtccgcctagggggaatgaaatggaaatgaccagaaattaaagctgtcataactaagcccgattgggatgtgaaaatttggaaaccctgggaatgttgtggagaggaatatttcgatgacatagaagtcatagctgaagaggggaatgaagatctttggcaagctcgcccctcgtgcacaggaaagtgaaagctgaacaactccagcaaaattggagttggctgatccaggagaatctcacaatcagtgtatatcactctcactatcactatctcactgctacagaactcctaaagattgcaaagacgtttaaacaaccacctaaggaaccactgacctcttagatggtccaattgtgggacacagggtttttctttagctgggaatcaagcagagaaaaatgattaatatcatcacccacctggtcctgcagcaataccttcataacccaggaagaatagccttatggaatggattattctagctatgagagaggcttggcctaatgagaaagatttaccaggagggacaacctgctggtggtcaatcaaagaggccctggggcttctctgggaattaggaatgaggcaagccatctatacctgggttttcacaggaactgatatagcagtttttactgccagggtgaaaaataaattgctacagcatgcatgaagagaatggcagggcccttttctgtctttgttgaggcctggagtggaacaagatgtatatgatgtgggacaaggcattgcaaatttggaaaaaactgagcaaaccagggacagggtaagcttgggaacctgacgagggttagcaaaagggaaaaagaaaatcccacagaaagaaggaggaaaaaaagggaaagggatagataagaggcacatgtaagtaaatgtggcatgatttattgggagcagaaacaccccaataaaaaatagacaaacaacctaacgctgtattagcagtcacatagagggaactaccgcctaaacagcaatttcgttgcttcctttctgcccctcctgcagaagaggaagactagaccccttcttgtaatgccccagcctatcagggtggatcccatccgggctccgaaattactagggccgaggttaatcccatgtttgaacaatagagggcgaccagaggccccatattgagctcatcacttactggtcctgagaattaagactattgccttactagggacagaatgtactttaatccatggacacattcagaaagaccctttggtcaatggtctgccattgatggttatgggggacaaatgatcccggtaaaaaggactttaatacatctcggtttggggaaagtgtcctctgccccatatatggtgcttatttcctctattccataaaatattttaggcatggatattctgttaggaaagactgtaaacttcagtggaagaattcagattaaaggtgggtatagtacaggtattctcaggagaggtcaaaatggaaacccgtacaattctctagccccaggtaggttgtcaacgttaaacaatacaaattgcctgaggggcatactgtaataagtgcagctattgaggaacttaaaaggtacatattatccggccaactcaaagcaagattatcagttccatctggcctgcatgcaaacctgaccaggcctggctgatgactgcgggttaccagaaattgaacaaggtaaccctggccatacaagctgcagtttcttaaattactcaggtagtcaaccacatcgtgtctgtcctgggtacacatcatgctgtcttaggtttggctaatacctttttctgcattctactgtccaaataatcacaaaaccaattgcttttacctggcaaggtttccagtggacctttcaagtgctgccctagggctatttcacactcctacaattcgtcacccaatgatagctagagacttgtctttgctctcactcctgacttctcttttttagtcttcttatatttataatatggcgttaacctctgagatgttcatgtgtattatgaaagtctgagggcattgtgcaatcatcttctggaacaagggtgggaaatcaacccttcagaagatctagggcccagggcctgcagtgaagttttaggggttacatggtggagtaagattccttttatattgggtacattaatggacaaaatccagtaatatccaactctgaaaacaaaagagaaatccaaacatctgtgggtcttttaggatattagagagcatttgtcccacccttagcccaatgtttgaggccactatatggacttattagagaaaggaaacattgagactgagacacgtcacagcagggagctttgaacaggctaaagtgctagtatagcaggtgcaagcctcaggcacccctttagagggagtagagatgactttggatgttactgctactcctgtgggcaggagttgggccttatggcaaccacggtatggtaaatcaatccctttaagattttggtcacaattacggaaaggagcgaagccagatactgaaaggaaattttccctgaccccttcacaggcctcatgacaggggtgccttgcttactcagcccacagctctcaaccccttgtgggatgggaagcatgcaggtgagctcgtgtaagagccagggaaagtgctttagggtgctggcaggagcaaaactctgtgcgtgccccaaggcagcatctaaggaggataaaactcccgtgggcccccaaaaccccagggcatgcattacagtgagctcttttagctttactgcccgaggatggcttaagtaagtgtttaacagctcagtggaccttctgccttttcgtgagggcaaagggtcagtgtgacagcctttttgtattccgagctcttgtccagcatccaggaaaaatcagattgcacgaacgaattgaaggataacaaatgcaggggattttattgccgatggaagtggctctcagcaggaaagggagctggaaagaggaaggagcaggagagtattcttcccctgaagtctggccatcttcagccagactgttctccaaagttctgccatcaagccatccctctgaagtcaaactgcacctctccaatgttcagctgcttcttttcttctccccttctctgctctctgccagtggagcctggggtttttatatgtacaggatggagagcatggcgggccaggggtggttttggaaaaggcaacattcgatcaggaaaacggggatgtgaagttctcactttgggctgcggttccaagcttgaaggtggggccctcgtcagggactccacttcttctgcctagaatttatctgcctcctgtccctatcagtactctcccattgaacaagtgctagcagtgtatgctttacagaaggtggaataattagcaaagacccttcccatgactgtgagaactggtctaccaatcaagggatgtatagaaggattatttaaatcacccacctccgtttaaatcccaaacacctatcttgaataaatggcatgcctgtttgcaacaatgaagtgtcctggtaaccaatcccttaagccgagaattgcatgctgtgttaggccttgttatatgtgagcaaccaaaggacatccctttgccccttcctaccccagtgtgtgactcgataagcaaaggagtgttatgcatccctgatcatgcttggtatacagatggctccagcaagggaaacccctgtacttggaccgctgttgctatatgaccacaaactgatacaatctggcttgatataagtacccatcacagtagacagtgggctgagttgcaagctgcttggttaataatcacacataagccctggcccctggctctttgtgctgatagctgggctacattcaaaggcctaattatgtggctagcccagtggcaacaagaaaaatgggtgtttatgcacaaacccatataaggcatgaacatgtggcaagacacatagagaagctgcaacaccttgcagctgatgaaatagttggtatttcatgtagtggtacacaataggactcagttccaggaagtatagaagctgacaccctaagaacaattagaagcattgtgctctgtcccaggccaataaatagagacctgtgtacataacaaaagtagtagtcatagaagtgcaagagtaggcttggagatagccaagaaggcaggattgcccttaaaatatactgacctcccaatagctgttaaaaatgttgatatggtttggctctgtgtctgcacccaaatctcatgttgaattgtaattcacacatgtcaggggaggtggctggatcatgggggcggttcccctatgctgttctcatgatagtgagtgagttctcatgagatctgatggtttaaaggtgtttggcagttccctccttgctctctttctctcctgccaccatgtgaagaaggtccttgcttcccctttgccttctgccatgattgtaagtttgctgaggcctccccagccacatggagctgtgagtcaattaagcttctttcctttacacattacgcagtcttaggtagttctttatagcagtgtagaaacggactaatacaaatgtataccacattcttgattccatccacactatatactataccatgcaggacacactcatagggctgtctaccctataacagatcagcaaatgaattatatagggcttctttttgtaagtcaagacaaaaagtatgtattggcctgtgtagatactgctactgaactgctgtaagtttgtccttgtaagtgagctaatcaagccagtactattaaaggtttagaggctctcagtactatgtatggatatctttgacacattgacagtaaccaaaagacccattttgctggacatgatgtgcaggactgggccacggaacacaacagatcatggcattttcatctcccatgtaacctccaaacagcagggttcactaaaaagaaaactggtcttctgaaagcacaaattcagtttcctggggaggctgagcatggtggctcacacttgtaatcccagcactttgggaggctgaggtgggaggatcgattgaggtcaggagttcgagactagcctggccaacatggcgaaaccccatctctatttaaaaaaaaaaaaatacaaaaattagctggccgtggtagcacacacctgtaatcccagctactctggaggctgaggcaagagaattatttgaacctgggag[132 bp omitted]aaatacctgagactgggtaactggaaaagaggattaattggctcaccgttatacaggctatgcaggaagcacagcagcttctgctttgggagaggcctctgaaagcttctgatcatggtggaaggcaaagggggaacaagcatctcacatggcaggagcaggagcaaaagagagtcagagaggaagtgctacacacttttaaacaacctgatctcacaagaactcacgcactattgtgaggatagtacgaagggggtggtgctaaaccattcatgagtaatccacccccttgatccaatcacctcccaccaggccccacctccaacattggggattacaatttgacatgagatttggtggagatacagatccaaaccatatcacctatcacctaccttgctagagtggatgaatgtgtgatctgcagggcttatgtatttaacttcagccaaagcaggatgcttgctccatatgacttgttgggaccaccgtaccccaagcctaccactatttgcatatgggtaactgagaagaccgctttgctcccagacctgattgacaaccagcatattttgtgcataacaacactgacagatatactgtcaggggagaggacactgcactggggcttagaatggcaaatacccccaggctggataggctatttcttgccatagatgggggaatatcctcaacagttagagtggttcccattgctcctattgaatactggacccatgatcacccgctataaatggttaggggaaacagtattataagcgaactaacacaggaacaaaaaaccaaatactgcacgttctcacttgtaaatgggagcaaaacattgagtacacatggacacaaagaagggaacaagagacaccagggcctacttgagagtggagggagggaggatcgaaacactacctataggatactaagcttattgcctgggtgatgaaataatctgtacgccaaacccctgtgacatgcaatttacctatataaggaacctgcacatgtacccctgaacctaaaataaaagttttttttaaaaaaagaagcacaaattcaaactttcctggagaaacctaccttgcaaaggtggatgaatgtgtgatctgaagcccttatttctttaacttcagccaaagggatgaggtgcctgccccatgtgataggttgggaccaccattccccaagcctactatttttcacatacgggtaactgagaggactgctttactttcagacctagttgacacccaccatattttctgcatgaagacagtgacagacattctaccagaggaggggacactgcactggggctcagaatggcaaatacacccaggctggatcggctatttcctgccagagatgggggaatatcctcaacagttagagtggttcgcattgatcttattgaatactggtccccgatcactcattataaatggtcaggggaagcatatataccccatggcatggtggtgagctctctaatatggtgtactctcaatcaaattactttgaccacggctgctgacacttcatccttgggcaacatggttggtatatggcccctttccctttacaaaagccaagagctgactctatactaactactctaaatgaatggactggtgtattctgacagatggaaaataaatttccttgcaaatacccactaagtttgtttcctttcatccttagttgtcatgttctgtcaatactatcactagctgccacctaggaagcaaaccttttcctacaatgggcccaagagtatgctgttggcttacagaaaaacatctgttggggccgggcacagtggctcacacctgtaatcccagcattttgggaggctg[134 bp omitted]gaggcaggagaatcgcttgagcccaggaggcggaggttgcagtgagctgagatcacgccactgcactccaacctgggcaacagagcaagactccatctcaaaaaaaaaagaaagaaagaaaaaaagaaaaacattggtttggtatgcggcctcatgccactctcccatgcttctggcctgccgtggtgggtatctcctttccaaggatgagattggagagactatataacacaaatgaccaatttctcagactgaacccctgcgttgaatgctgtagttgttactggcttcatagctggcttcggtcctggggcacctggtggcagaagctgcttcttggtttaggtgttgtgctcctatgttccttactgtcctggttttgcctttactgttgctgcagcattttcctccaataaagccaatgagctgctgctatagctatacaatatcaagcaccctccctctagacccagggactatcaaggaacaggtgggcacgtgagattgcaaggaccagtactgaggagtggagtgtaggtatacagcctgctgcatggccagagtgatttcatcttgaagggaaaatatcatgatgacagatgtttgactcccgcataccaaggtatttggcaacaaggtctttaaacattggccgtagcgtagataatgtctcataaagatgcttatctaacctctccagtggtcaagagtttctgcaagaaagtatgagacatggccaggtgctcatgttttagcataaaaattttctatagaaagtaaactttctggaggacgggtgtgggttccaccctcttgcagccactggacacatagcttctgttcaaaggtccccattaattgtttatttctgagaaactcgatttgtcagcctctttctttggcctctcagtgcccttggcctttgagggtaagtttacatagaactgctcaccacggaacaataccaatgtgcccaatatattgtctttctttctagagcaattactacaacagtaggaaataaaatgttacaaggtgttgtctttctttctttctttttttctctctttctttctctctttctctccctctctctttcctttctttctttctttctttttttctttctttctttctttctttctttctttctttcttttctttctctctttctttctttctctcttcttcatttcttccaacacagagtctcactttattgcttaggctgcagtgcagtgctgtgatcttggctcgctgcaacttccgcctcctaggttcaagtcgttctcctgcctcaacctcccgagtagctgggattataggtgcccaccaccatgtccagccaatctttgtatttttagtagagacggtgtttcaccatgttggccagggtggtcaggaactcctgacctcaggcgatcttcccgccttggcctcccaaagtgttgggattacaggcgtgacctaccatgtccagcctgctgatctctttctgatgcattctctccatccccatctctctaaaccctctctaacagactctcagactttcctctccctcctacattctcttccttttcttttgtctctctctgctcctcacctcttgactaaagatgttggcggctgcatctctagccaatgtccaaatcctaatactacaacaaacatggccagtgacatctgcctttaagcacttgtcacagaggtcacctgtgcatcgtccacttccagcctccaaagaaacaattcactacaaaccacttctggagacgtggcaccaactaccagggaggcagccagggaaggatgaggaactctcatcatcatatttctgctcgggaccaaggttcctgaactggaaagggcccatctgctcagccctccccatcacccctaacccctgcaatgctgcaggttttcataaagttgtttttttctctactgacacctacaagcttctcacttttgagaaacaaagattgtaaaggttttttttcataattaactaaatttaatttagagcaaatttttttttaactcatgtgttttagttagtaaaacaccatcttgggccaggcatggtggctgtaatcccagcagtttgggaggccgaggtgggcggatcacctgaggtcaggagttcaagactagcctggccgatatggtaaaaccccgtctctactaaaaacacaaaatttagccaagcgtggtggcacacgcgtgtaatcccagctactcgggaggctgagccaggagaattgcttgaacctgggaggcagaattcagtgagccgagtgcagtgagtcgagatcgtgccaccgcactctggcctgggcgacagagtgagactctgtcaaaaaaaaaagaaggaaagaaaggaagaaaggaaggaaggaagcaaagaaggaaagaaggaagaaagaagcagataaaaggcagagacagagtgggccacttggtgaggcggggatggagagtcacctgcctgaggcacacccacccaactcacaggtgaaactggagcggaatcaatgaggaactaagtcagggatctggctactcttgcctctctctagaggaccccttgccctgccatcagtcccactgagaaccctcattgtgcttcctccaggacaaattcacatgtctagtggaatccatggagagccctcccaaggcaaaaagtcaggaactgcaggctaatgcttccctcccactggacaggcctggggaagactgggaaggggctaagggaagcagagaaactgccttctctgcccaagagcaacagacatagctgcagggcaggaatgagggacccacatctgatacacttgggaccgggcttcagaaagtgtcccctccctatgttgtttgtgtctcagcaggtgattttgtccaatcagcaggtgattttgtccagccctcttcccccaggtaccaggaggtaccagctgcactagcaggttcaaaggcctcaggggacgaccctgtgtcccagatttctgagcagatggcctaagctactttgctttgcagctctgcagactaaaaggaattagctccagagaccagggaccaatggggctgtgggaacttctgggccaaaggtggaagagcacttcatgaattattcaagatttgatagatagtggcatctgaatttcgctaccagcaggcagtgcagaactcaacatccacctggaaaagatgttgagcctgagcaccagtgccaccacctttcaaggatgctatgcttggtggtccggctgggttgggctgctgtcatgggaacccaagttacacagcccccctaacacatcagttttgccagaaggttcaggccacagggctgggccatcatctggacattaatcccccaggtgctgaggaagttgctgaggcaaagaaaggagcagcaaggtcactgcaagtagagggtgtttcagccaaggatgctcataaattctatcctttactcagctcaccctgcctatccttcagaggctcagctgagaagctattcacctccactcccattcctccagagtctctggactagcccagtttcacagaaacgccccttaaaatggagaatctgattctacaccatgaatttatcctagcttgataaatcagctagagagcctgatttattggcctaggagcacccagaagaaacctgtaatctggcaatgacaagtttattaaccctttgcaatgagagaaacttcacaccagaaggactatagaatgtctcaccaaacaaggaaaggatagagattttataggatctgaggaaagaatgaaacttatgtgaaattatacaaaccctgccatattggtccatgccatgttgtctaccaagtatattaactgtgaggagcacatctgtgtatctacttctaacgcagagtttctcaacctcaatgctattgacatttcatgctggataattctttgttgtgggggctgtcttgtgcatggttggctgtttagcagcaaccctgacctctatcaactagatgccagtgtacccccagtcccagctgtgacaaatgaaaatttcctagacattgccaaatgtcccttggaaagcaaaattacctctggttgagaaccactgctctaatagtttatcgatagtggaagtgaatactaagtaaaaggttttgtggaatggcttttatttttaggaaaaaaggtattaaatgaggggcacattaaaacgacaaatctgtggttaacggtaagctcattgttaaaattaaaaaataatatcagaggccaggcgcagtggctcactcctataatcctagaactttgggaggccaagacgggaggccaagatgggtggattgcctgaggtcaggagtttgagaccagcgtggtcaacatggggaaaccccccatctctactaaaatacaaaaaaattagccaagtgtggcagcgcgcgcctgtaatctcagctactcgggaggctgaggcataagaattacttgaacccaggaggtggaggttccagtgagccgagattgtgccaccgccctccagcctgggtgacagaacgagaccttgtctcagaaaacaaaacaaaacaaacaaacaaacaaataaacatagccagcccagcacagtggctcacacctgtaatcccaatactttgggaggccaagacaggtggatcacttgaggtcaggaatttgagaccagcctgggcaacatggtaaaaccctgtctctaccaaaaatacaaaaataagccagatgcagtggcactcacctgtagtcccagctactggagaggctgaggcactagaattgcttgaacttgggggcggaggttacagtgagccgagatcacgccactgcactccagcctgggccacagagttagaccctttctcaaaaaaaaaaaaatagcatttacgatatcataaaaaatgttaaatatttaagggtaactttgacaaaggatgtgaaagacctgtacactgaaaattacagaattgctgggagaaactaagacctaaataaatgaagagatataccttgttcatagattggaagagtcaatattgtttagatgtcaattctccccagatttaatctataggtttaacacaatatcaatcagaactctaccaagatttttggtaaaaaaatggcaagctgattctaaaattcatatggaaatgcaaaagatctagaatagacaaaacaactcttaaaaaagaaaaacaaagctagagtgcttaacactgtctgttaaactagtgttaaactagtgttaaactagtgtttaacactgtctgacccaataattattataaagctgcaaagcaaagtagcttaggccatctgctcagaaatctgggacacagggtcgtcccctgaggcctttgaacctgctagtgcagctggtacctcctggtacctgggggaagagggctggacaaaatcacctgctgattggacaaaatcacctgctgagacacaaacaacatagggaggggacactttctgaagcccggtcccaagtgtatcagatgtgggtccctcattcctgccctgcagctatgtctgttgctcttgggcagagaaggcagtttctctgcttcccttagccccttcccagtcttccccaggcctgtccagtgggagggaagcattagcctgcagttcctgactttttgccttgggagggctctccatggattccactagacatgtgaatttgtcctggaggaagcacaatgagggttctcagtgggactgatggcagggcaaggggtcctctagagagaggcaagagtagccagatccctgacttagttcctcattgattccgctccagtttcacctgtgagttgggtgggtgtgcctcaggcaggtgactctccatccccgcctcaccaagtggcccactctgtctctgccttttatctgcttctttcttccttctttccttctttgcttccttccttcctttcttcctttctttccttcttttttttttgacagagtctcactctgtcgcccaggccagagtgcggtggcacgatctcgactcactgcactcggctcactgaattctgcctcccaggttcaagcaattctcctggctcagcctcccgagtagctgggattacacgcgtgtgccaccacgcttggctaaattttgtgtttttagtagagacggggttttaccatatcggccaggctagtcttgaactcctgacctcaggtgatccgcccacctcggcctcccaaactgctgggattacagccaccatgcctggcccaagatggtgttttactaactaaaacacatgagttaaaaaaaaatttgctctaaattaaatttagttaattatgaaaaaaaaaaacctttacaatctttgtttctcaaaagtgagaagcttgtaggtgtcagtagagaaaaaaacaactttatggaaacctgcagcattgcaggggttaggggtgatggggagggctgagcagatgggccctttccagttcaggaaccttggtcccgagcagaaatatgatgatgagagttcctcatccttccctggctgcctccctggtagttggtgccacgtctccagaagtggtttgtagtgaattgtttctttggaggctggaagtggacgatgcacaggtgacctctgtgacaagtgcttaaaggcagatgtcactggccatgtttgttgtagtattaggatttggacattggctagagatgcagccgccaacatctttagtcaagaggtgaggagcagagagagacaaaagaaaaggaagagaatgtaggagggagaggaaagtctgagagtctgttagggtttagagagatggggatggagagaatgcatcagaaagagatcagcaggccgggtgcgaattgaaaaattggatttcatcgaaagtaaaaaatctgctgtttaaaggacaccattaagagaatgaaaaaaaaaaataaataaaacaagccacatattaggagaaaaaaaattgtaaaggatgtatctgttaaaggatttctatccacaatatagaaaagactctcaaaactcaagtataagaaagtaacccaggggccaggcacggtggctcatacctgcaatcccagcactttgggaggccgaggtgggcagatcacctgaggtcgggagtttgagaccagcctgaccaacatggagaaaccgcgtctctgctaaaaatacaaaattatccgggcatggtggcgcacgcctgtaatcccagctactcaggaggctgagggaggagaatcacttgaacccaggaggcagagtttgcagtgagacgagattgtgccattgcactccagcctgggcaacaagagcaaaaattctgtcaaaaaaaaaaaaaatagtaacccaatgaaaaagccgaaaagatatgagcagaaaatatgcagatagcaaataagtacatgaagaggtgctcaacatcattgtcattagggatatataaaaatataatgatataccactatacactcattaaaatagctaaaattaggccaggagaggtggctcacacccataatcccagcacttcgggaggccaaggcaggaggatcacttgagtcaaggagttcaagatcagcctggagcaacatggtgaaatcccatctctaccaaaaatatagaaattagttgggcaaggtggcttgtgcctgtagtctcatctacttaggaggctgggatggg[136 bp omitted]atatgcagctattaggaatgtaaaatggtacaactgctttggaaaccagtttggtagtttctttaaaaatttaagcatgcacctagcatatgagccagctattccacgctgatttttacctaggaagaaaggaaatacatgtccatacaaagacctgaacaaaaatttgcctagcaactttatttataatagccaaaaactgggaaggactcaaatgtccatcaacaggtgaattaataaataaattggtgtatattcatacaacataacaacatagatgaatctgaaaatagttatgctgagcgaagaagccaggaaaataagggcacagactatatgactctcttacataaaaccctatttatttattttttatttttgcgatggggtctcgctatgtcgcccaggctggagagcaatggcgcactcggctcaccgcaacctccgcctcccaggttcaagtgattctcatgcctcagtctcctgagtagctaggattacaggcaggcaccaccatgcccgctaatttttgtatttttattacagacagggtttcaccatgttgcccagggcggtctcaaactcctgagctcagcgatctgcctgcctcggtctcccaaagtgctggtattacaggcatgagccactgagcccggcctcttattaaaacttcataaaatgcaacttaatttttactgacagagagaagattggtggttgcatggagatgggagagtgggggtggggatgggaggaagggaatcatggatatgtttactatcttgattttagggaaatatatatctatatcaattgtatactcttaatatgcacagtttattgtatgtcggttatatctcaataaagttattttaaaaaatctttatagacagtaacaaagtctctccagcaatggtctgttacgccagaaatacatacaagaaagtctaagttggccaggcgtggtggctcacacctgtaatcccaacactttcagaggctgaggagggaagattccttgaggccaggagttgagacgagcatgggcaacatagcaagaccctatctctacaaaaaataaaaatttatgtgaaaaaaagatgaaagtctaagttattgaaccataaaaccgacagatatatttttcttttacttttcttttttttttctttgagacagaggcttgctctgtggcccaggctggagtgcagtggcacgacctcggctcactgcaacctctgcctcccaggttcaagcaattctcctacctcagcctcccgagtagctgggattacaggcacccgcaaccacacccggctaatttttctatttttagtagagacgggattttaccatgttggccaggctggtctcaaactcctggcctcaaactcctggcctcaaactcctggcctcaggtgatctgcccacgtcggcgtcccaaagtgctgggattataggtgtgagccactgtgcctggcatgacagatatttttctgatgtcatgctcaacagcaatggttcaccttgaggaagataacaccatctcccacatcttgggttttcccactcttttcaagtgatatagttgtgatttgtgcaatatttcatcaatgtaaagtttacttttttttttttttgagacagggtcttgctctgtcgcctagactggtgtgtagtggtgcgatctccgctcactgcagcctctgcttctcgggttaaagcgattctcctgcttcagcctcccaagtagctgggactacaggtgtgtgccaccacgcctgactaatttttgtattttcagtagagacagcgcttcaccatgttggccaggctggtctcaaactcctgacttcaggtgatccacctgctttggcctcccaaagtgctggaattacaggtgtgagccaccgtgcctggccaaagtttacttcttaaaaaaaaaaaaaagaactgaaaatatactatggagtgaaataatttggggctcaataaacaatattcttgggtaatcatggggaaccccaggagccacataatgctggtctttctttcttttttttttttttaaagatggagtctcgccatgttggccaggctggtctcaaactcctgacttcaggtgatccacctgcttcagcctcccaaagtgctggaattacaggtgtgagccaccgtgcctggccaaagtttacttcttaaaaaaaaaaaaaaagaactgaaaatatactatggagtgaaataatttggggctcaataaacaatattcttgggtaatcatggggaaccccaggagccacataatgctggtctttctttctttttttttttttttaaagatggagtctcgccatgttggccaggctggtcccgaactcctgggctcaagtgatctgcccaccttggcctctcaaagtgctaggggattacaggcatgagccaccatgcccagccaatgctggccttttcatccacccaaccttgggtcagaaggtccacagcatcccagggtaggtcctgccctcacacagagatttgttgccaccaccagtgcagagggtctttgctgttctccatgaaaaagtgctgcacacacagacctccaccattctggttcctcacaccacagtctgcagctctgacagtcagcaagtccctccatacagctggccacagacttccctgcctgcagatgtgtccctgtcatttacacgtgttctctgcaggactggcgtttagaatctcctatggtggagagcagagctgtggggaaggatcagccagacagggtctttgtccttcctctattatttgttgactgtctaactttggacaaatcttagcctctgagtctatatctgtggcatggggcaataaggccatctacattgcatgtttctggggagtatgttttacgactccctgtgaacctggaacagagcaggcacagagtaaatgcgtagtattattctcatcatgtttgtggtttaacaacagctaattgttttttgatcactcacaatgtgcccagacctatgctaagtgctttgcaagcacaccttacaacagccctgtgtaggaagtacaatcattacctcatttcagaggaggaattggagggcttaggaggtcaggtgacctgtccaaggtcatcaagtgttggggctgggaagtgaactcaagtctgtgtgactacagagcccatatccctcctgtattagtctgttctcacagtgctataaggacatacctgagattggataatttataaaggaaagaggtttaattgactcacagttccacatggctggggaggcctcataatcatggtggaaggggaaggagaagcaaagtcacatcttgtatggtggcaggcaagagagcatgtgcaggggaactcccctatataaaaccatcagaacttgtgagacttattcactatcatgggaccagcacaggaaaaacctgccccctttgattcaattacctcccactgggtccctcccacaacacatggggattatgggagctacaattccagatgagatttgggtgaggacacagccaaaccatatcacttcccaataggctggactgcttaccaccccatgtggcctcaaagagctccagtcactcctttacgaacccaatcactccagaactttagaacaaagtttctgagttactccttgtaataggctaaataatggctcccaaagatattaggatttgattcccagaacctataaatattaccttatttggaaaacggttcttagcagatgtgattgagttaaggatattgagatgcagagattatcttagattatctagactatctgggtggatgtattggtcagggttcttcagaggacagagccaataggatatatgtatataaaaagggagttaattagggagaattggctcacatgattacaaggtgaagtcccacgataggccgtctgcaaactggggagagaagctagttgtgtggctcagtccaaatccaaaagcctcaaaactggagaagctgacagtacaagccctagtctgaggccaaaggtccaagagcccctgagaggctgctggtgcaagttccagagtccaaaggtcaacaaacctgaagtctggtgtccaaaggcaggaggagaggaagcagacaggaagagagaaagcaaacagactcagcaagaaagctgctgttcttccacctgctttgttctagccacgctggcagtcaattgcatggtgcccatccacactgagggtggatcttcctctaacagtcaaacactgactcaaatgtcatcttctctggcaacaccctcacagacacacccagaaacaatgcttcaccagccatctatgcagccctcaatccagtcaaggtgacacctaatggttaatggttattaaccacggttaataaccatgacagtgggttctaaatgtaatcacgtgtatccttataaaaaaaagaggcagagggagatttgaagagctatacagaggagaagacaacgtgaagatggaggagagagaaatttggccatcaagattggagtcattgatatagtttggatgtttgtccccttcaaatctcaggctgaaatgtgaatcttgatggtggaggtggggcttagtgggaggtgcttgggtcatgggggcagatccctcatgactggcttggtgccctccccatggtaatgaatgagttctcactctgttagttcacacgagagctggttgtttaaaagagcatggcatctctcttgctccctctctttgccatgtgacatgcctcctccccttcaccttttaccatgattggaagcttcctgaagccctcactagaagcagatgctggtgctatgcttgcacagtctgcagaactgtgagcatcaataaacctcttttctttataaattaaccagtctcagtattcctttataacaatgcaaaatggactaatgtggtaatgccaccagaagccaaggaatgccaacagccatcaaaagctggaaaaggcaagaaaggattctcaccaggcatatggtggctcacacttgtaatcccagcactttgggaggcggaggtgggtggattgcctgagctcaagagtttgagaccagcctgggcaacatggtaaaactctgtctctaccaaaaatacaaaaaattagcctggtgtgtttgtgcatgtctgcggtcccaggtactcagggggctgaggtgggaaaatcgcttgagcctgggaggcagaggttgcagtgagccgtgattgtgccactgcactctaacctgggtgacagagtgagacccccatctcaaaaaaaataaacaaaaaaaaaataaaaaaagagaagaaagtattcttcctagagcctgagaagggagcatggcccttctgacaccttggttttggcctagtaatactgttttcagacctgacctccagaactctgagagaataaatatgtgttgttttctgccaccaagtttgcggcaatttgttacaacagccaccggaagttcataccaattttggcacctagagggggagcgctgctgtagcaaatacctaaaaatgtgaaagtggctttaaaattgaataataggtaggtaggtgccagaagaatgttgaagaacttgatagaaaaagcctcgatttacgtgaacagactgttgggagaaatgtaaacattgaaggcaattctgatgagggctcagaaagaagtgaggaacatgggagagaaagccaatgtcatcttcgagaatacatatatcatcataccatcctaagcagaatgctggtagaaatataaacattaaagctaccattagtggccggtcactgtggctcacgcgtgtaatcccagcactttgggaggccgaggcaggcggatcacctgagatcgggagttcaagaccagcctgaccaacatggagaaacaccacctctactaaaaatacaaaaacattagccgggcatggtggtgcatgcctgtaatcccagctacttaggaggctgaggcaggagaatctcttgaaccagggaggtggaggttgcggtgagccaagatcatgccattgcactccagcctgggcaacaagagcgaaactccatacccccctaaaaaaggtgccattagtaagagctcagaaggaaatgaggagtatgtactcggaaactagaggaaatgcaattctagttacatactggtagaaaacttaactgaattgtgtcctccagttatgtggaaaatagaaattgcaagcaatgtgtgttatttatctgaaacccaaactaaaaaaaaaaaagagagagagagagagagacagagagattgagagattgtaagcaatgaacttggatatttacctacagaggtattgcaagcaaagtgttaagggtatggcctgattccatcttactgcttttagtaaaatgtgagaggaaagagatacactgaggaaaagactgttaagcaaaaaggatccaggacttgatgatttgggaaattctcagcctatcaaggttgcaaaagacactaaaattaggagaggcactgtcaggaaggtatgggaaggtatgctctagagacaatgtcaagaatgtggctatgtttgctagtgctgaggagattaggcacatgactcaaggagctcttccactatgctcagccatagctgctaatagaaatgatattatctgggaaagatacagaaggacctgctggtctaagggtgtgaatcactatgacatacattctgagaggagggctatgggaccagaggggagagcttcaagctacaggggattattctgagtccttgaaaccaaatggaatttgtcccgctagatttcaaaatggttgggagcagggactccttcctttcttccagtttctctcatttgaaatggaaatatctgtaactattatcctacacctgtcccgccactgtatttttggaacagataacttgctttctagtgtcacaaattcacagcaggagaattttgccccaggatgtttcataaccagagtctcatccatatctgttttagatgaggagacttggtacttttgagctgatcttatatggataagatggacttcagctaatgttgcacagtttgagacatttgaggatttggggatggggtgcatgtattttgcatgtgggagagatgtgaatacttgggggccagagggcaggctgtggtagactgaacaacacccctccaaaagatagcgatatagtaacccctggaacctgtgagtgttaacttacaacaaaaaatgtgattatgttggccaggtatggtggctcacgcctataatcccagcactttgggaggctgaggcgggtgggtcacgagatcaggagttcaagaccagcctggccaagatggtgaaaccccatctctactgaaaatacaaaaattagttgggcatggtggcgggcatctgtaatcccagctactcaggagggtgaggcagaggttgcagtgagccgagatcacgccactgcactgcagcctgggtgacagagtcagactccgtctcaaaaaaaaaaaaaaaaaagtaattatgttaaaaatcctgagatggggagattctcctggattatctgggtgggccctaaatgtaataatgagtgcctttatcagattaaggcagggagatctgacacagacagaagagaagaaggcagtaagcctgccatggtttgaacgtccccaccaaaacttgtgttgaaatttaattgccattgttaacaatattaaaaggtggggctgttaggaagtgattaatgccattatcataagagtggattagttatcacgagattgggtttgttataaaagggagcttagtcacattttctctgtctgtctcctgcacttgcttttgcctttcatccttccatcatgacacaaccctcaccagatgccagcgccatgttcttggactcctagcctctagaactgtataccaaatgaacttctatcctttataaattacccagtttgtggtattccattatagtaacagaaaacaaacgaaggcaatgaccatggaggtagagattagagtgatgcagccatgtattagtccgttctcacactgctataaagagctgcccgagactgggtaatttataaaggaaagagatttaactgattcacagttccgcatggctggggaggcctcaggaaacaatcatggccaaaggtgaagaggaagcaaagactttcttcacatggtagcaggagacagaagtgcaagcaggggaaatggcagacgcttgtaaaaccatcagacctcatgagaactcactgtcacaaaaacagcatggggaaaaccacccccgtggggatttgtaatctgtggggattacaattcgagatgagacttgggtggggacacagagccaatccatatcaagccacaagccaagaaatgctggcaatcacgggaagctggaagaggcaaggaacaggttctctcctagagcctctggaggtgtacagccctgccgacaacttgatttcaactcagtgaaactgatttcagatttctgggctccagaattgtgagagaataaattgatgttgtttatgccacaaagtttgcggtaatttgttacagcagccagagggaatttggggtgattgtaaggagttatgtaaattatgttaaagaacctttgcagttgtaagatgcattcattcattcaacaaatagtcgaggcaatatagaagagtaattaaaagcaccgactttgaggccgggcgtgggatggttcactcctataatcccagtgttttgggaagccaaggcaggaggattgcttgaggccagcagttccttccagatcagcggggacaacatagcaagaccccatctcttaaaaaattattttaattaaaaataaataaatacataaataaaagcacagactttggactcaattcatcttgggggtgaatcccagctctgtcacccactgactatgtgacctcgagcagactgcttaattctctgagcctcagtctcaacatctgcacactggggatgataatagtatttaactccagagaaggttgtgaaaactaatcggaagatgcacataaagggctttgtgctggactaaagggccattgccctgtccctgccctaagagagcttgctgtcatcctgggaggatcttagagagatcagggctgtagatggaaagcccagagaggaacggggtcatgttggagatactagggatgggggtaggggaaacttcttggacaaattgacttatgagctccctgatgaacacagtgggcccgaattacatactctttttaatactattacgataaacattattaatatcaatgggtaaaatatatttctggttctttggtcttctagaaaaaaacatatatagaagttttttttttttttagtttgaatttcttttttaaattttttttatagagatgggggtctcactatgcatcccagattgttctggaactcctatcctcaagtgatccttccacctcctgcctcagcctctcaaggtgttgggattacaggcatgagccactgggactggctcattgaaatttttctttctttctctttttttttttttctgacaagatctcgctctgtggccgaggtaggcagcagtggctggatcatggtcactgcaacctcgtactcctgggctcaagtgatcctcagcctcctgagtaactgggactacaggcacaccaccccacctcgctaattttatttattttttgtagagataagggacagggtatcgctctgttgtccaggctggggtgcagtggcgtgattgtggctcactgcaacctctgcctcccgggttcaaacgatccaccagctgtggcctcccaatgtgctgggactacaagcatgagccaccgtgcccggcccaaatttctgacgttactacagagttcctaggaaaaatcccatacctgaaaaagttagaaactgacaggaaggatttgagatgacgacctgcttcatatacactacttattaaaactggataacaaatgcaccgcgggggggtggggagggataggaaaaaaatggaaagagaaaatcagcacatgagtactctgattttggaagaatctaaagagaatatcagagcatgcatactctgaacttggagtagccaatcccaggggacgctttaggcgggaaaatcagagtctccacccccactttgagaaggttgtgtccctggagcctcaactgatagaccccacatcaccttcgctcctcccacctactgttctgacttctgattggccaaatggagttcactaactgccctgattggtccatcatcctggggcagtgacattgcagaatattttctcctcctccaaccacactttgtcaccaactgctgccgacctcgccaccactgctttgtctctgaggtaggttctcttgaagggacaccctagatgggctaatgggggcagatagaaaaggaggaagcctctgtagggccctcgagtgctcggggttctgaaaatcttgaggactgaaagacagctaatgcctttcaggaggatcatcatggaggatcctcccacctcggcctcgggtctacaggcctgtgtcatccaacccctggaaatatttttttattttgtattttagtagagacggggggctcaagcaatcctcccgcctcgacctcgggagtacaggcacgcaccaccctgccctcactaatattttttattttttatttttcttagtagagacagttctgccatgttgaccaggctggcctcaaccgcctgggctcaagcaatcctcccgcctcggcctcaggactacaggcacgcaccaccctgcccccactaatattttttattttttatttttttagtacagacggttttgctatgttggccaggctggcctcgaccacctgggcttaagcaatccttccgcctcggccctgggactacagaagtgcaccaacctgcccacgcttttttttttttttttttttttttaattattagaagccgggtttcactacgttggccaggctggcctcaacctcctgggctcaagcgatcctcccaccttggcctcaggactacaagtgtgtgccattccacccctgctagttttttgtttgtttgtttgttttttgtttgtttgtttgttgttgttgttgtttttagtagagacggggctttactatgttggctgggctggtgttgacctcctgggctcaagcaatcctcccacctcggccttagaactataggcaggagccaccttgcccgtgctatttttttgttgttattgttgttagtagaaatggggttttgctatgttggccaggctggctggacctcctgggctcaagagatcctcttgcctcggccttgggactacaggagcgcaccaccctgccccgactaatattttttatttatttatttatttattttttagtggagggtttcactaggttggctaggctggtatcgacctcgtgggctcaagcgatccgcccctcccttggcctgccaaagtgctgagatgttacaggcctgtgccaccacccccagctaattttttttgggtttttttttttttttttttgtagagatgggggttttgctatgtttcccaggctggtctcgacctcctgggctcaagcgatctgcacgcctcggccccccaaaatgctgggattacaggcatgagccaccacgcctggccgattgctgcaacttgaaatgccccacattctctctaagtgatggcgggctcttgtagtcttggagattctagctctcttccttctaatgatttacaaataacccagtaatagcctctaaatccgttcatattggccatgctcatttctcatcaacagaacagaaccccccatccctctgcctgatcagatccatcaccagagagaccatgttatctctgggactcacttcccttccttaatttattgagtggtggtgtcagaacgcccccactcaataaaattacacagtcatgtccctgcctccccaacaagggtctgtacgtctttcagggtaagcctggctccagggaaactgctaacaacattagccaaccccctcccaaagactcaaggctgctatgtccataggaaacttgtcatccccaatcaatacttctcccagagacccctggctccctgttttcatctgacttctccccatgtccttactcacgggcagataagtcccggatgcagaaatgcaacacctgattccaggtgactgagtgtggccggccttcacagatttctccctccgcaggactggaaagactcaggctgtttctcttgcaggtcagagtgctcctggtgccatgaacggagacgacgcctttgcaaagagacccagggatgatgctaaagcatcagagaagagaagcaaggtgaggtgacctggagggggcagagcagtggtccaggggacagagtagggtgaccaggtttctgaggaggggaggacagaggtactggggacaaggaccagggtctcgggggagatctggacccttgagagcctcccaccctcgctctgtcatcacctaccatccctggagacaagtctgtgaccttgctctacatttggtaactctcactccattctggaaggtgggaagagagccagccagcatcactgaagccctactgtgtggcaggggagaagctagggaaggtccccatgttctgtcagttagccatggcatcaaccaggacggattatcatccccaattcccagatccagcacacaggaagcggctccagctgaatggcagacatgcctagttgagtcactgccagaatttctttcttttttcctaggccttcgatgatattgccaaatacttctctaaggaagagtgggaaaagatgaaattctcggagaaaatcagctgtgtgcatatgaagagaaagtatgaggccatgactaaactaggtaacagaaagttctaggaacagacaagtctggggacacatgagcatcccttttcctgcctaggctacttcttagactgcagaaagtaccccacgttttccttttgtgcagggaaaaatggcaaggcagctcctgggtgttctgctcttctgtatcctgtcagggctgagggcagggactggccacagtggagctcgtacctggatcctgcacgtttctttcccataggtgtctgttctgatgagcccagctgtctctgtggcatcacagcacacctcccaccctaccttcctcctctggtcttgtccctctccgtctctctctctctctctttttgagtcagagtctcactctgtcacctaggctagagtccagtagtgcaaccatagctcaatgcagcctcgaactcctgggctcaagcaatcctcctgctcagcctatggagtagctgaggctacaggcacatgccaccatgcccaactaattttattttatattttgtagatatgggggtctctctgtgttacccaggctcttcctgaactcctggcctcaagcaatcctcccgcctcagcctcccaaagtgctggtacgacagacatgagccaccgtgccaggcctaagtttgtcccttaaggaataaacattttgcttctttctaggtttcaacgtcaccctctcacttttcatgcgtaataaacgggccacagactctcagaggaatgattctgataatgaccgtaaccgtgggaatgagggtgagtagatgggaagggactggaaagggtctcctcaagcccaactgcttttcagctcagctacctgggaaagatcctcaggcatttgttctctcatacacaacagggctgagtgaaaaaaaattgcaggcggaaagttaactacagaggccattcatataaaattttaaaacatgcaaaacaagaatatatatttttatggataattagtaaatggtaaatgcatgaaaacatgaatgtgaataaaaagccatcaaattgaggagactggctgtaaatggagaaggagcaggggcagggattggtgagtgctgcacaggcagcttcagtcatgacttgttgatagtgtgttttgttttgttttgtttttgtttttgttttgaactggagatttgctcttgtctcccaggctggagtgcaatggcacagtctcagcccactacagcctctgcctcctgggttcaagcgattctcctgcctc[134 bp omitted]agcctcccaaagtgctgggattacaggtgtgagctaccgcacccggcccgtttatagtgtttctaacattctgaataaataaatcagatctaacatagtcatggggtaatgttgagatgcaactgaactcaatattattccccatacttttgtgtgtgtttgaaatatttcttttttaaaggacatgttgttcttgctaaacactgctaatgaatcaaaggacagttaagaaaatgttaaaagtgaaaaacagaaagaaaatgttaaaagtgtagagccgccaaaaacttccagagtttgtttcattaacagcatgtagatattggataaatatcttaagagagagggtgatgcacacattatgtaataaagatcgctgtttctctgtattttattaaaaccaaatagtcttctcattcccaaacaaccccgattctccgtgatgagcttggaagtgagtttgaaagagtgatccctcatccaacacacagagagctttcccacttgtcagtgagcagagataacacagggtgaaaaaaaagacaggttcttgggtagagagctttgtgcagttcaggaatataaaggggtcatatgtgtttcctggctcttctgctctgacaatacaatcataagacaaggtcagaatgtccaaactgtctccaatagacctgttactccccaacagacaggccagattctacaatctcccacaatcactacaagaggtctgaaaatccagtgcttgagtatctgccaagcttttgactttaaaggagtgtctttatactgaaaatgtttcagagccaccggactaagtcatccatggttcatcacacatttaacagcttaattgacataccataagatccacccatttgaagtgtacagtgatttttagtttgagtggatacagttcagattcccaaccaatcaatttaattatttgggaaaaagtaaaagatatgtaatggaataagatgagactgtgatggggtttaaccccatttgataaactatgagatggaaaattctgaattgatgccacagataagtgaaccaaccatgactaaacataattcagaagcaaatctcaaataactcctcaagaatcagtagactcataaacctctgctgcagaatgccctgatgcgacagaagtctgtctagagtttgggaatctttaccaacaaagaaaaattctaatgtattctctttcagttgaacgtcctcagatgacttttggcaggctccagagaatcatcccgaaggtgagtatctctcaaatctacaggaccagagaacctttgtccctccacggatgtgaacactggtaagagcgggagaatatcaaaaatgtcctcattgcctccttctccccatgtctatcacaacaccagatgtggcatcaatggcttgataatactaacagttgtgatccttaatacttcttttgttttcatagtgatgccagatactattttaagcagttcagatggattaattaatttaatccataagaagacctctatgacattgtttctgttattatctccaaagaataacaagtcacacactttggttgtcatccatatgaaagccatgtgacttggcgcaaatcttctaagttctctgagctccagattcctggtccatgaaatggaagtaaagaatcatagttcatgttttagatcatagttatcagcaacataataataaaatgaggctatcgtggtacagagatgttaaagaattttcctgaggcgcagtgtcagtggtagtctaatccagagctccaagccatttaaagctcattcacgtctgcatttgtttatgaagttcagatgttgctcactagggcttcaccccatagggcctcctggtgcttccgttgagacacccactctcacaacaggaaggaccagctggcctctgctctgttaccggggccactcgcatggcttaggaatcgctttgactgttggcccctccatactgtgagctccttgagggccttgtctgcacctggggcatccgggaaaccccagtcccagcccaggggatccatcggaggcccctgaatgagtgaccccacaattgcagattcaactctggtttagatggtaaagggatctgggagctgggttgccagtgtggagaccgaattcaaagcaggatccagaaaggtattaattgttattattattacatttaaacagtgtttacaagctcagagaggaatttcccttagcctattttacacatatttttcactatttcataagtgaggaagctgagtaaaaagtaccttaagggcccggtgcggtggctcacgagtgtaatcccagcactttgggaggccaaggcaggcagatcacgaggtcaagagatcgagaccatcctggccaacgtggtgaaacctcgtctctactaaacatacaaaacttagtggggcgtggtagtgcctgcctatagtcccagctactcgggaggctgaggcaggggaatcgcttgaaccggggagggggagattgcagtgagcagaggtcacgccactgcactctagcctggcgacagagtgagacgctgtctcaaaaaaaaaaaacaagcccaccagcctggcccagttcaatttataaaaatgtggcaatcagctctccctctacctctccccagggtctccctctccctctctttccacggtctccctctgatgccgagccgaagctggactgtgctgctgccatctcggctcactgcaacctccctgcctgattctcctgcctcagcctgccgagtgcctgcgattgcaggcgcgtgccgccacgcctgactggttttcgtatttttttggtggagacggggtttcgctgtgttggccgggcaggtctccagctcctaaccgccagtgatccgccagcctctgcctccggaggtgccgggattgcagacggagtctcgttcactcagtgctcaatggtgcccaggctggagtgcagtggcgtgatctcggctcgctacaacctccacctcccagccgcctgccttggcctcccaaagtgccgagattgcagcctctgccctgccgccaccccgtctgggaagtgaggagcgtctctgcctggccgcccatcgtctgggatgtgaggagcccctctgcctggctgcccagtctggaaagtgaggagcgtctctgcccggccgccatcccacctgggaagtgaggagcgcctcttcctggccgccatcccatctaggaagtgaggagcgtctctgccccgccgcccatcatctgagatgtggggagcgcctctgccccgccgccccgtctgggatgtgtggagcacctctgcccggccgcgacccagtctgggaggtgaggagcgtctctgcccggccgccccgtctgagaagtgaggagaccctccgcctggcaactgccccgtctgagaagtgaggagcccctccgcccggcagccgccccgtccaggagggaggtggggggtcagccccccacccggccagccgccccgtccgggaggtgaggggctcctctgcccggccgcccctactgggaagtgaggagcccctctgcctggccagctgccccgtccgggagggaggtggggaggtcagccccccgcccggccagccaccccgtccgggaggtgaggggcgcctctgcccggctgcccctactgggaagtgaggagcccctctgcccggccagctgccccgtccgggagggaggtgggggggtcagccccccgcccggccagcccccccgtccgggaggtgaggggcgcctctgcccggctgcccctactgggaagtgaggagcccctctgcccggccaccaccccgtctgggaggtgtacccaacagctcattgagaaccggccatgatgacaatggcagttttgtggaatagaaaagggggaaaggtggggaaaagattgagaaatcggatggttgctgtgtctgtgtagaaagaagtagacatgggagacttttcattttgttctgtactaagaaaaattcttctgccttgggatcctgttgatctatgaccttatccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccacagggtcctctgcctaggaaaaccagagacccttgttcacttgtttatctgctgaccttccctccactattgtcctatgaccctgccaaatccccctctgcaagaaacacccaagaatgatcaataaaaaacaaaacaaaacaaaaacaaaaacaaaaaagggtagcttaagattgttggtcagtgacacatcccaatgcaaccagaattgttatgggcaccacctcactgaattccacattcaatgtcggtgcctcggtagggtggtatgtcatatctggtactgctttctttgatgtctagattaatttcagcaaaccatttctttccctctctcttccctgtattcatctccccacaccatctttcccagcagtgttttgtcccctctctatgtctttacatttactctcccagcagctgtctacaagcttatattgggatccctcgtattttatagaagcttttccttttatagaccttgtgaattcttagaatgctattctccaaaacttctgtataccacactctcaattacagggagatttctgctgtttgcacgaatcttaaaagagtgtgaagataagcattctagccctggaaaccccattcatttaggccattcctttcgcttctaacctcccaggtttctcctaatttaggcacatgtgactctcccagcgttgttgagaacattgattaaggtaatgcatgtgaagacactttgtaagctctaaagcactatagaaatgtcactgatactgtttatctgtgaccttcatattataaagatcatgcccgagaagccagcagaggaaggaagtgattcgaagggagtgccagaagcatctggcccacagaacgatgggaaaaagctgtgcccgccgggaaaagcaagtagctctgagaagattcacgagagatctggtaagaggaaacgatttgggaacaacccctctggcttccctggctatgttcaggtgtgtggactgggtgtgtggcatggatcccagacaagcctgggtccaggctaggctgaggagctcgcccagctccagatgagatgttacacatgacttccagagacacagactggagttgtcatccatataaaaaaccatgtgacttggggcaagtcttccaaattttctcagctccagattcccagtccataagatggaaataaagaatcatagttcatagattgttgggaggcattgaatttaatctaggaggcctgatgacatgaacggtgctcaggcgattctatctgtgataacctgggaacctgggatcacatcttactcagctcaatgcctgatacccaatacaggtgtacttcagagatattgcaggttcggttccagaccactgcaataaagtgagtcacacacattgttttttgtttgttttgcagtgcatataaacattatgtttacactacagtgtagtctactaagtgtgcaatagcattatgtctaaaaagtacataccttaattttaaaataattcattttttaaaaatgctaacaatcttctgagccttcagtgagtcacactctttttactggtggagggtcttgcctcggtgttgatggctgctggctgatcaaggtggtggttgctgaagggtggagtggctgtggcagtttcttaaaagaacacaacaatgaattacatcgattagctctccctttcatgaaagatttatctgtagtatgtgatgctattggatagcattttacccacagtagaacttctttcaaagttggagtcagtcctctctagctatgaaagttttagatggcatctgcttccaatagaaggctgtttaatctatattgaaaatctgttgtttagtgtagccaccttcatcagtgattttagctagatcttctggataacttgctgcagcttctccatcagtgtttgctgctacaccttgcacttttatgttatggggacagcttctttccttaaacctcacaaaccaacctctgctagtttcacacgtttcctctgcagcttcttcacctctctcagctttcctggactggaagagagtttgggtcttgctctgaattagactttggcttaagggaatgttgtggctggtttcgtcttctatcctgaccactttctcatttcagcagtaaggcagttttgctttcttattcgtgtgttcactggagtattagtattattattttcttcaagaacttttcctttgcagtatatactattatttccttcaagaacttttcctttgcattcacagcttggctggtgcaagaggcctagctttcagcctgtcttggctttcagcatgcctcctcactaagcctagccatttctagcttctgatttaaagtgagagacatgcgactcttcctttcatttgaacacttagcggccattgtagggttgttcattgtcctaatttcagtattgctgtgtctcaggaaataatagggaggcccaagaaaaggaagagaggcagggaagagctcatcggtggagcagtcagaacacacacaacattaattgattacgttcgtcatcttctgtgggcgcagttcttagtacccccaaaacatttacacagaacagggtgactatagtcaataataacttaatcatacatttaaaaataactaaaagagtgtaaatggattgtttgtaacacaaggataaatgtttgaggggatggataccctattttccacgatgtgattactacgcatttgcatgactgtatcaaagcatctcatgtaccccataagaatatacacctactgcgtacccacaaaataaagaacaaaaattattttaaaagactaaaaaacaacaaaaacaattgcaataataacatcaaagctcactgatcacaaatcaccataacagatataataataatggaaaagtgtaaaattggtgagaatttctaaaaaaaaatgcagtatctgcgaagcactacgaaaatgaggtgcaataaaacgaggtatgcctgtgtgcccttaacaaatacttgcagaatgaaaggaggtaagggtgaatgttcccgtaagtgaagaggttggtaatctaaacgtcacaacagaaggagccagaagctaaaaactttaattggtatttgtcgtgtattggtgtgggtttaaggtctcagcctctctaagccagagaatgtgaaaaactggataaagaaggcccatgggcacttgggaggggggaggcatctcctgcttttgagaaaacagagcgtaacactctccaacctacccaaccctcatctcccaactcttctccatcataggacccaaaagggggaaacatgcctggacccacagactgcgtgagagaaagcagctggtgatttatgaagagatcagcgaccctgaggaagatgacaagtaactccataagtgaaccttcggctcaccctccacatccctgcagatgtgctattctgttatggtactggtatcccatctgtcacttgttccccaaatcattcccttctcataattttctactgtacagcattgaggctgaacgatgagatttcccatgctcttcctactccctgccctgtatatccagggatcctccctaccctggatgctgtgggctcccaaaccccaggtcagcactgatatgcgggccacacctttctctagcctagaaattgataactcaggcgaggaagtcactgtggcatgaacagatggttcacttcgaggaaccgtggaaggcgtgtgcaggtcctgaggtagggcagaatcagagtgtgcagggtctgcaggtcaggaggagttgagattgagttgccacgtggtgggaactcactgccacttatttccttctctcttcttgcctcagcctcagggatacgacacatgcccatgatgagaagcagaacgtggtgacctttcacgaacgtgggcatggctgcggacccctcgtcatcaggtgtatagcaagtgaaagcaagtgttcacaacagtgaaaagttgagcgtcatttttcttagtgtgccaagagttcgatgttggcgtttccgttgtattttcttgcagtgtgccattctgttagacattagcattttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgattttttcctctgcatttacacacacaccacacacgcacacacacacaccaagtaccagtataagcatctcccatctgcttttctccactgccatgtgtcctggtcaagcccccctcactctgtttcctgttcagcatgtactcccctcatccgattcccctctatcagtcactgacagttaataaacctttgcaaacgttccccagttgtttgcacctctcattattgtgcacacagctctgtgcacgtgtgtgaatatttctttaggaaagattcttagaagtggaatcgctgtgtcaaaggagtcatttattcaacaaaaccctaatgagtgcgtcctcgtgctgagcgctcttctaggtgctggagagacatcagggaacaaggcaggctgatgttcctgaccaccattctagaggaggatgtctccagttgttgggtttgtttgtttgtttgtttgtttgtttgtttgtttcttctagagatgggggtcttgctctgtccaggctggagtgcagtggcatgatcatagctcaatgcagccttgaactcctgggctcaagcgatcctcccaccttggcctcctaaagtgctgggattacaggcgtgagccgcagcacctggcgtccagtttttattttgatagagactatacacttcagtcctggagcaggattctgcagcaggtggttgggcatctcggccttcgctctctgaacgattttcgcgttctagggctgggacggtccatttgggagtgtgtgggaggagacacagatgaaatcgtcatctggggaatgcagaggaatgagggagatgcgtgcactgtagaccctgtgatggccagggaatagaagagtccacttagtctccatgcaggggagcaacggtgggaaagtcccctggacagaagcatgagactgcccatcaagggtctcaccaaccaagggcctgggggctggggtggggacgatgatttgggaatgggacagttctttgtcacacgtaccattgcacggtgcagaggggaaagagttgtggggaggggaagggcagaggggagtctattttagaataaaacatttgtgtgtgaatggagacattaaagctccattcacaagcgatggacttgaaacaccagccccaggtggaggcaggatcagagctgttttgattgtccatagcccatcaccttggcctcttgcttctccccagccttggaaggaggaaactaccatcattatgcctatatgataggtgagagacggagtcccagacacatggtaggcatcttgtcacaggtcctacagctggcaggtgcaggaggggctgagtttggagctcactgacttcagaaacattaaggaggacaggtgtgtgtggtggagggagggagaattgaacaagtcccaggttctgtccccagtcacaaggtagaggctgtgggttcattttccaagacaaggaacccttagagatggagagtgcagggagggagaggcaatcgtgaacatagtggggacagtgggagacagagatgtgcagcgtggggagaagagtggcaggcaaagaagcaggggatacccaagattaagtgtgggctgtcacagccaccagagggagagggtgctagtaaggaggttgtggggctccaggagcaacagaggttccccagatctgtgagcatgccctgcctggcactgcaggaagaggtggctgccacccaggtcagtgtggacgtacctctacctgtgtctcagaggaaacaaattctattttatcccaatatagctctgtattacacaaatgtaacattcggctactagatatggagtgccttatcttccatgtaaatacagcagaggataccctaaaagagatactgaaggatttgatttttctttctccctgggaagatggaatccataagttgggtccccaagcccacaagacaggtgcaagaaagggtggctggaagattgtgagtcatgacagggaacatttttccttaggttccttgggtatataaagctcccgactatctgtctatcatggatagataaagagtgaacatggtcccctctccacaaatgtgtttctctccttcattattactgtgaagggctgaaactccatcaagttctgatacattactcttttttttttttttttgagattgagactcactctgtcacccaggctggagtgcagtggcgagatctcggctcactgcaacctccacctaccaggttcaagcaattctcctgccccagccttccgagtagctgggaatacaggcgcgtgccaccatgaccggctaatttttgtatttttagtagatacggggtt[137 bp omitted]tctcactctgtcatcccggttggagtgcattgctgcaattacagctcactgcatcctcgatctcccaggctcaagggattttcccacttaagcttccgaactagctgtagctacaggcacacaccaccacatctagctagtttttgtattttctgtagacacaggatcccactatgttgcccaggctggtctctatctactcggtccaggcaattctcctgcctcagcctcccaaagtgctaggtgcggtggctcatgcctgtaatcccagcacattgggattccaaggcgggcagatcacttgaggtcatgagtttgagatcagcctggctaacatggtgaaaccccctctctactgaaaatacaaaaattagcttggtgcggtggtgagcacctgtaatcccagctagttgggaggctgaggcaggagaatcacttgattctgggagatgtaggttgtagtgagctgggatcacgccactgcacttcatcctgggcaacagagcaagaatccatcgcaataaaatcgtaaaaataaaataaaatagaataaaacaaaacaattgctagttatttttgtattatgacttttgagctccattcttgttgcctaatatttgttaagtcagttctcccaacaggataatgttggcctagtgcttcaagatgattgctaatacagctgggactaacacgatgaaacttgatactgaactccagacaaacctgcctgattttctttttccttctggctctttatggctcaaatgtggcccatgtccctgatatagaccccttacctttctcttgacatagaccggcacaggtccatcctggtatggagtgacaatgaaacctcactttcagatggctgatcagtgaggttttcaaagaaagatcttcatcaaaagagggaatgtgaaagctgatttgttacaaagagcatctcctgggcgggcgcagtgacccacgctgtaatatcagcactttgggaggccgaggcaggcagatcacttgagatcaggagtttgagaccagcctggccaacagggtgaaacccccgtctctactaaaaatacaaaaattagccagccgtggtggcaggctcctgtgaattccagttactgcaggggctgaggcaggagaatcccttgaacctgggagacggagggtgcagtgagccgagatcacgccactgcactccagcctgggcgacagagtaagtctccgtctcaaaaaacaaacagcatctttcgcctacagtgatttgagctgtggtcttgtctccttgggtttctctatcagtctgaccccatctactctatctcccaggaatgcctcaatatttctggtggaccactgacatgttttcctattttcctctactgttaagaattgacccttgaaaatattttctcccagttcgatagaatgttgagtggggcacggcatctatctgccatcttgctccaatcatctggttttagatattttatgtacttttgtcactatataagtgtattttttctcaatttggttttctaaatgattgatattggtatgtagaaaacctatctattattgtatataatattttgttacctgtctgtgtgcagcttcccctgcattttggcacaagactcaatttgttttgttctccaaaagaaaagtgacaggctgggtgtggtggctcacacctataatcccaccactttgggagtcggaggcaggtggatctcgtgaggtcaggagtttgagaccagtctgaccaagatggtgaaccaccttctctactaaaaatacaaataaaaaattagccgggcattggtggtgtgcacctgtattcccagctactagggcagctgaggcgggaggatcacttgaactcgggaggccgagattgcagtgagccaaggtggcaccactgcattccagcctggtggacagaaactctatctctaaataaaaagaaaaagaaaaaagaaaattcacttcacaggcagtagatagttataaaaggataatttatgggcgatttcataggggagactgatggaaaaaaaggaagtatacattctacagagctgagcagttcactgcaaaaatcaccagaactgcctttttctccaaaaatattacccataagctattctactactggtttttctagtccttccctctattccaaatcctcaaaattgtccttttccttattgggataattttcctctgcccagatctgggtcctccaccacacttaacactgtctgcaagtgtgtgaattcccattggctttgggccatacaggacacctctagacagactatactgagaagccatgcttggaacggtgcatggggagaggacaggagagggaatttacatacctggctctcactcctggttcttttacttattggtcaaaatttaccccacaggcacgaactcccccacacttctagattgcatcatctgcccctttggcagctgtctgggaagccagatcccacactttgaagtgtagtgtttcatacaatccaaaagtggtagcagaggccaggcgtggtgtcacatgcctgtaaccccagcactttgagaggccaaggcgggcggatcatgaggtcagaagttcaagactagcctggcgagcatggtgaaaccccgtctccactaaaaatacaaaaattagccgggcatggtcgcacgtgcctataatctcagctacttgggaggctgaggcaggagaatcacttgaccctgggaggcagagcttgcagcgagctgagatcgcaccatgacacttcagcctgggtgacagagcaagactccatctcaaaaacaaaataaagcaaaacaaacaaaaaatcaaaaaggtggtagcagaaaccagaaagtccaggtatgtagctaattggcctagttgtacagcagcagccaagggtgaaaactaaatactcccaggcaagccctaagttcaccaagtaattggagtacccatctgtgttagttaattgcctttatctgaaggaaaaataaaactcatatttctgtgacaagcaggtgcttacagcttggagcaaggcatctaggctaaactcccctggtgacagggagacagtgacatcatcttcctcgatgttcacatttcaaaaagacggctccaaggccctaaagaaagacatttatagggaccgggcatggtggctcacgtttgtaatcccaacacttttggaggctgaggctggaggatcacttgaggcctggagttcaagttcaagacattcctgggttatagggtggccagaggcttacatatcaaaggaggaatttacaagtacaaattttttcgaggaaatgctctaaggaaagtgaagtctcttcttgcccttttggcaacaggaaaatctcaattttatgtttagttacccttacaatttcccccttttgttattcttttatagcaacactgcaatattctaattatctccactgctgtttctttctctgcctagtttacagccacctagatatccaacaagtccatagtaagatgcaaagcaaagcaattgtcaagataataatagaatgatttttttttcatgacggagttttcatctcattgcccaggctagagtgcaatggcacgatgtcagctcactgcaacctctgtctcctgagttcaagtgattctcctgcctcagcctcccaagtagctgggattacaggcatgagccaccaggcccagctaattttgtatttttttgtggagatggggtttcaccatgttagccaggctggacttcaactcctcaccccaggtgatctgcccacctaggcttcccaaagtgttaggattacagatgtgagccaccatgcccggtctagaatgaatttttaaattcagtataataatcaccttgtcagggggtggggcgatctttaaacacatcatattggttaattgtgtcaaagtcaaaataaattatagagacaaatccctaaatcaaatgctctatttgggaatcacaaaattacaattcagggcatacacacagactagggtggtcttcagtatgtgcaatgaacaaacagaagttggaagttttattagaaagaaaaatgttacatattgtttagaaatgaggctcattggcactggagaagctggttcatttgcacaatcagctttcacattccctcttttgatgaagatctttcatcaaagtgtttcgcactttgaacttggagggcagcaacagggttgcaggtgtaaaataacgggaaggcgggatgcgtggctaaattgctctgcgtgcacaaagagtaggaggtagggaaaagccactggcttcatccagtggccaggactgggagtttacgttgtagcgtttgaaggacggtgggtcggtatgcagacaaacaagctgaaaaataaacggcgatgtgggacacacacaccgggggtgaaggggtatattaagtggtggctaacaggttgctttttctggatgagtagacagtgtcagtgtgttgggagtgtagggggtgtaggctggggccaggtgctgtagggcctccttggccagggagctcatatttcattctggacatatgggaaaccataagaaggatccgatctgtaaagaccagtctgaagcaatctagcattatatagtaacgttaaaaatacacatatattgggctgggtacggtggcgtgcgcctgtaatctcagcactttgggacgccaaggtaggcggatcacctgaggtcaggagttcaagaccagcctggccaacatggtgaaaccccgtctctactaaaaacaccaaaaattagccgggcttggtagcacgcctgtgatcccagctactctggaggctgaggcaggagaatcgcttgaacccgggaggcagaggttgcagtgagccaagatcacaccactgcactccagcctgggcaacacagtgagactccatctcaaaaacaaaaaacaaacaaacaacaacaacaacaaaaggaatggagcttcccagtagacaagacaaagaaagaaagaaagtaaaaaaggaactcacatctgttgctccctgacacatcagcacctcctgggtatacaatttatccactctctcaatgcattaggaggtagaaaatagaaagggctggtcctttagggcccatcaagtgtcgccccttctagcacctaaacgtcatctccaaccaccttgtacacacacacctacacaaaggaggaaatcttttagggttggtgggagttggggggcagaggagccagtgatacagcccctcagaaactatctgagggcccacagtgtgcatgcacaagctatgtgaggctaactttgctgctgcagagcgaggactcccactctctgtcctgggtatcctctaccgtcattccctacaggtgtgacctcctcatacagtaacctaagcagcaggtggctaggtgaaggagagtgagaagctgacaggtggctggtcccaccacagagtctgcatgatatgacattcccacccaaagacaatgagagaagcccccacgtggctggcgagtcatcattacaattgctcttatgatacattttatcaagaccacaaaagccttgccaattgtgagcggtcattttggaccagaagcagcaggtgaggctgacagagcaacagcacagaaggagccaggtctctggtgaccttggagctaccacactagccctggattacctgcctccaaaagaggaatctgcttccctcctcttgaagccactggtgtttgtggtggggttggtgcgtgcagccaaatcaaatcctgagcaatccatcagatgcttctgtgttggccaatgtgagtgtcagtgaacaggagatacatgggactggtgggtgaggggcatgaataatggtgactgaagggcaaattgggagtaaatgagagcaaggagaggcaaagggcaatggaatggaggtgaatgaacaccagagtggagtggatgtgggccaaagtgagggaatgactatgcatgcattcaattatgaatgaatttgagattatgatgagattaagtaaatgatgggaaatgaggcacagtctcagtggaaaaaaggtgaaagtgggagcagactctgaatgaatggggcaactgaagggggtgaatgtgagtggagtttatgtgagtactgaggattagagtgtgaatgaatggtggttttatgaggcacaagatgaatgaagagaggggaatttagggagacagtaggagtgaatgggggtaatgtgggatggaaagggaagaatggggtgcgggagggacagaataaaagagtggagatggatacatggtagaatgtgaagcaggccgagtttgagtgtgggtgctacgagggagaaggatgactagagatgactgggattacatgggcgttatacagggtagtagcccaggaacgtgggtgcacagggatcccagtgggaatcggcaaatgtgaatgagctgaagagtgcacatgaatggaggtgatgttgggcagagtgagagggaatgaaagtgaagagcagaggatgggtgaacgtgggtattgtgaggcagagagtggatgaaggcttcatggcctcgggtgagtaaagcgaggaaacatggggagcccgatgtgagcaaaagtaacgaatttgaggcacagcgtgacagaatgcgggtactgggaggcagaatggcagccatgaatcaggagcagaatatgagcaagaagagggtgataggggttacagtgggaatagatttaaaggaatgaggcagtgagaggcagagtaagagtaaatggaaacaatgaagagaaaactgagaaagaacagtgactggagtgcagtggtgcgatcttggctcacttagcgtaggctaagtatatgtgggtaacttcagctagtgtttgggagtaatagggacagagctccaggaaatgggggtgttcctgggacagcatctgagagaatagaggtgaaggaggggcagagggggagtgaaggggggaaataatgaggccccgggtcaatgaaagaagctgaaggctgggccacgtgcgagtaagccagagtcatttgatgcaggggcgggaaatagaggcaaagataggaaatgagtctgagtgagagtgagtggggtgaagaaggaatatgacatgaaagaatttgggtaatgctaagtagactgtgaggaattgcgataatatgaggcccagtatgggtgaatataagtggctgaaaggcagtgtaagtgaatggaggaacaaaaggcagaatgagaatgaagttgaaaaagcagtcaagcataagaatgtatatgtaatatgccatttgtaatatgaaatgtggggcacattccagtaaattaggatggaacagcactttaagtgcagagaggtgaacaaggtaccaaggatgagtgctatggtttgaatgtgtgccttccaaaattcagatgtcagaaacttaatccccaatgcaacagtgttgggaggtggggcctttaatccccaatgcaacagtgttgggcgatgttgaggcttctgtgttgcgcgttccagaatctaccacttagacctttgctcatagagcccagagttccagaatgcccctaattccgaacaccacagggtgagtctggagcaagtcacctgggagggcttacaggtgccataatgaaggcctggggcactgtggtagtgaccttggccacgctgatggttgtcactgtggatgccaagatctatgaacgctgcgagctggcggcaagactggagagagcagggctgaacggctacaagggctacggcgttggagactgtgagaatccagttgccccaaatcccatccaaaccctgagccacccgccacattcagacccaggccccttcttgtcctttatcacctctccaggcctgggcatgatcccttgagtcactccctgactgactatgctgagtagtttaactaactctaacaccaccaccattattgccttcacaaccatcacctccatctctgccatcaacaccatcactacaatcaatatcatcaccactgttaccatcatgaataccatcgctaccaccatcactgatgtctcaccagaatcaccaacatcaccaccactaaaccaagatcaccaccctcacaactgagatgacaaccatccctgtcctccccccatcctatccttccctattcccaagctctatacctactccctgcctcccttctccctgccccagggctgtgcatggctcattatgagagtggctttgacaccgccttcgtggaccacaatcctgatggcagcagtgaatatggcattttccaactgaattctgcctggtggtgtgacaatggcattacacccaccaagaacctctgccacatggattgtcatggtaagtcagcactggggacccactgaagccctgctgggccctactctcccacacatggagggcaaggttgtttaagccataatctcctgcaacaagagaaaaatgatgggaaaaggagaaaagttgcctgagctattaaagacaccatcctctacccctacccagactatcctgagaggttgtttaggacagaagagctcagagctcccaatcctcacccagaatggacactgcagttttcttagactcaggaaacaggaaacttacctccatgtggaacagagttagaaactgtcctgatttggggttgaggttacccaggccccgaggaaagaagcagagtgtctggttctagaaacagaaacagataacctccatgcagaaatgacagaactttccagataagactggtggtgttgaggacaaaatagaatagccgttaaagttgttcagtgttggccaaaatggtggttgaggttgtccaagacaggaaaaaatggagactgaggttatttggggccagcccaaatggaggttgaggttgtccaggaccagacagtatggaggttggggttattcataactagccaacatgacaatctagatcatccaggatcagtcaacatgagttaaggttgtacagaaccagctaacatggtgattaagatcattcataaccaactgacaagagaatcaaggtcatcaagaatcagtcaacatagtggttgaggttcttcaggccccaaggaacccaaaacccttgggccctccattcactgttatcctatccccagtgcaccagaccaccatgtccctctcttccccctcagacctgctcaatcgccatattctggatgacatcaggtgtgccaagcagattgtgtcctcacagaatgggctttctgcctggtaagttcatggggatggcccaggccatgggcagccagggatagtgtcactgccaccccatcaacctgtccacttcatcctctctcctttccttcatttcccaggacttcttggaggctacactgttctggccatgatttatctgaatggctcaaggggtgtgatatgcatgtgaaaattgatccaaaaattcatccatgactcagattcgaagagacagattttatcttcctttcatttctttctcttgtgcatttaataaaggatggtatctataaacaatgcaaaagatgctctgatgtctgactctcttcatttattcaatgcctggaggtaccctcattccgtcacttcctccatgtattcaaagctctaattaagaaataccagatcactcagagtggggaaggaagggaggatagtgttgtgaatcaagagcatgttgttctcctgggttcagaagccatctctaccacctactagctgtgttgccttggaagagatacttaaattctctgagcctcagtttcctcatctgttaaataaggatgataatagtaactacttgatggggttattgggaggattaaatgaattaatatttgtaaaacgcataaagtgcttggtacataagacagttgtaggtttggagatagaggagtgggatgggagagatgaaaattggcttcccttaaaaagaatcactctcggtggggtgcagtggctcatgcctgtaatcccagcactttgggaggccaagccaggtggatcatgaggtcaggagttcgagaccagcctggccaatatggtgaaaccccatctctactaaaaatacaaaaaaaaatttagccgggtgtggtgacatgcacctgtagtcccagctactcaggaggctgaggcagaagaatcgcttgaacccaggaggcggaggttgcagtgagccgagatcgcaccactgcactccagccagggtaacagagcgagactccgtctcaaaaaaaaaaagggtctttatttaaggcagatacagtctcttcaggggagaatgaatctaataggattgtgcttacacaggaagctcagtgggaatcaggagttaaaggtacgtttccccacatcctcccacataacaccattcttccagcccccagcccctctttcatgatcaaagtctgaagtttaaaatgacagagcgggaatgtaggcaaaacattcaatggacacacgtggtaataatttcttcttacagagtgcctgagtgtcactttgtgtcttgagcagagaatttaggaatttcaatttgccattctttgcaatggccagcacctttggaagcagccactcccataaggaagcagtccctcatgttctttgtactctttgattggggtggatactcaagcacctgagaccttgaagtgttcacttcaaccaggataatcacagatgagcatgaaaacagctagctgccactgcatgccaaggaatgccggagcccccttccttaatgccaactggatttcccccgccttgcaccccaaccagcctaggtaatcaaatctcacatctccctgtgggtccataaagagtgccaacactttgggtactgatttcttgttttttcttattttctttccttctttcctttcttttttcttttctttttctttctttttttttttttttgaaatggagtctcgctctgttacccaggctggagtgcggtggctcactgtaacctctgcctcccgggtttaagcgattctcctgcctcagcttcccgagtagctgggattacaggcgcccactaccacgcctgggtaatttttgtatttttagtaaagacggggtttcaccatgtt[135 bp omitted]taaatctgtaacttcctataatttgataaacccttttgttcttgtatggcacttattctccattatgacaaaacagcgatttttaataatagtagattttattaatttttctatgagagtttggtattaaatctggagacatttttcctgagtatcatttccaaggactatgcttatttaattaattaaattgggtttcctttaatacctgcatctagatttatggtgaggtttggcttccaactgacagccctcataccttcaaggccacaaaaggtgcctctttagctggtcatcagcttgccaggcttctagaaagaataataataatccacactctagcctgtgaatacagctttgtcagaagtaggtctctggtgggactgacttttctttcaagcctatataccagtcagaaagaaattccaagtacatttctttcctacaccctgagcttgagaaaacaaacaaacaaacaaacaaacccaagttgctctaatagaaattggaatgggaaagtgatgataaatataagtgaatttgattgtttaagaaaaatactttaaaagtggggagaggctgggcacggtg[234 bp omitted]tccagcctggggcgacagagtgaggctctgtctcaaaaaaaaaaaaaaaagaagatatttctgagctttcaaagatgtccagccctcactgacccactgcagtatccttctcatcacttcccatctgcttgcttgctttctttctttctttctttctttctttctttcttttctttctttcttccttcctttctttctttctgacaaggtctcactctgtcacctaggctggagtgcagaggtgtgatctcggctcactgcaacctccgcctcccgggttcaagcgattcttgtgcctcaccctcccaagaagctgggactacaggcatggccaccatacccagctaatgtttgcatttttagtagagaaggggtttcaccatgttggcctagctggtctcaaactcctgacctcaaatgattcacacgccttggctttccgaagtgctgggattacaggcgtgagccactgtgcctggcctgctcatttctttcttagctgtacaactcaaacttgggacttctctctctgtgatccaaagtcctccttcctccaaagaggcaatcacatctggtttggtcacgggataccctgtaacggaaaatgatacaagacttgggcacgtctgtgtgggctttgggacctcaaaaagttaggaaggcacatattcatgaggctaaatttcacataggagatgaaaatagaaacaccttgttcagtctaggagggattaagcatctttaatccctagaacctgaggtcaaaatattgaagcacttcagagatggaaagttattctactggatataccatgaattactcagagaagccatcctcacccacagagaccagatggctgtagttctgtagtatcacatctttatatctctctatatttctctagcatcacacggtcctctgaggaggatccagtcaattccaccactcctgggtgaaatccgcaagacacatcgtcaaatgacacgatccctgtaacggaatgcttctattcaattggttggataaaaattaaaatgataatactttttaaaataaagaaaatattcttcagagagaagctactctttaaccatttcaaaaagggcttttctgagatattcgcaatacctatatatagcaaaggacttttatactacagaaactataaagaactcctacaaacaataagataaatatagatagataatccagtagaaaaaacagaaaaaaagatttgaacaggtaattcacaaaagaggatatccaaatggccaataaatgtatgaaaaggtgctcaccatcattagtcatcagagaaaggcaaacttaaaccacagtgagataccactatatgccaacagaaaactgaaattaagaccaacaaccttcagctttcctgaaaggctctttgaattctttttttttttttttttttttgagatggagttttgctcccatcacgcaggttggagtgcagtggcacgatctcggctcactgcaacctccgccttccagtttcaagagattctcctgcctcagcctccgaagtagctgggattacaggcgcccgacaccacgcccggctaatttttgtatttttagtagagtcagagtttcaccatgttggtcaggctggtctcaaactcctgacctggtgatccacccgcctcggcctcccaaagtactgggattacaggcgtgagccaccccaccaggcccagctatttgcattctatttgagtctttctccccctaaatcctggatctgctacccttccaatttccttccaagtgttggccggatgtagagcaactgaagctctcatacattgttggtggaagtaaaatggtgtaggcacttaacagattggtagaatctactaaagctgaacatctaaattaacatctaagttagtttatctaacttatctcatctgcaagaggtagatgatacacctaacctaggatccagcaactccactcttaggtatatatccaatggaaatgcacacatatgttcaccaacacatgcacaagaatactcacagaagcattatttgtaatagctaaaatggaatatccaccagcaggggaatggattaacaactgtgttatatttatacaaaaggaatagtgaatagtatggaaaaagaacaaactactgacacataaggtaacaaggatggatctcaaaaacattatggtaagtaaaagaagccagacccaaaagaataataatgtataattccatttatatgacattcaagaactggcaaaaataatctatggtgatagaaatcagaaagtcgttagctgtgaatcaagagatagtgattggaagtggcatgatgaaggcttctgggtggcttgtcatttcctgctttttgatacaggtatgggttacaaaggtgttttcacttggcagaagttcattaaaccatatactttatacacttttctctgtatgttctgcttcaataaaaggtctgacccaaaacatttttaactaagttagttttccatacaaggttttaaaaaacagtaagagggccgggcacagtggctcatgcctgtaatcccagcactttgggaggctg[134 bp omitted]gaggcaggagaatggcttgaacccggag[136 bp omitted]tttgggaggccaaggcaggtggatcacctgaggtcagaagttcgagaccagcctggccaacgtggtgaaaccccatctctattaaaaatccagaaaatattagctgggtgtggtggagcatgcctgtaaccccagctacttcgtaggctgaggcaggagaatcacttgaacctgggagggggaggttgtagtgagctgagatcgtgccattgcactccagcctgggcaacaagagctaaactccgtctcaaaaaaaaaaaaaaaaaaaaaaagtaagagaaagatttaaaaatcccacaggaaaaagagtagcatttgggaaagaatgattcacaaaagaaatatgaaaagaaaaacgtatgaaaagatactcaatttcattgacaaacacacacaaaagaaatgagatattttcaactatcaaatggcaaggattagctctccctctccctctccctctccatctccctctccctcatccctctccctcatccctctccctctccctctccctctccatctccccctccccctccctctccgtctccctctcccctttgcacggtctccctctgatgcagagccaaggctggactgtactgccgccatctcggctcactgcaacctccctgcctgattctcctgcctcagcctgccgagtgcctgggattgcaggcgcgcaccgccacgcctgactggttttcgtattttttggtggagacggggtttcgccgtgttggccgggctggtctccagctcctaaccgcgagtgatctgccagcctcggcctcccgaggtgccgggattgcagacggagtctcgctcactcagtgctcaatgttgcccaggctggagtgcagtggcgtgatctcggcttgctacaaactccacctcccagctgcctgccttggcctcccaaagtgccgagattgcagcctctgcctggccgccaccccgtctaggaagcgaggagcatctctgcctggccgcccatcgtctgggatgtgaggagcccctctgcctggccgctcagtctgggaagtgaggagcgcctcttcccggccgtcatcccgtctaggaagtgaggagcgtctctgcccggccgcccatcgtctgggatgtggggagcgcctctgccccgccgccccgtctgagatgtgaagagtgcctctgccccgccgcgaccccgtctgggaactgaggagtgtctctgccccgccgccaccccgtctgggaggtgaggagcgtctctgactggccgcccagtatgagaagtgaggagctcctccgcccggcagccgccccatctgggaagtgaggagcatctccgcctggcagccgccccgtccgggagggaggtgggggggtcagcccctgcccagccagccgccctgtccaggaggtgggggggtcagcccctgcgcagccagcagccctgtcagggaggtggggggcagcccccaccaggccgccgccccgtctgggaggtggggggcgcctctgcccggccaccccatctgggaagtgaggagcccctctgcccagccgccaccccgtctgggaggtgtacccaagagctcattgagaacgggccatgatgacgatggcggttttgtcgaatagaaaagggggaaatgtggggaaaagaaagagagatcagattgttactgtgtctgtgtagaaagaagtagacataggagactccattttgttctgtactaagaaaaattcttctgccttgggatgctgttaatctataaccttacccccagccccgtgctctctgaaacatgtgctatgtccagaaacggttaaatggattaagggcggtgcaagatgtgctttgttaaacagatgcttgaaggcagcatactcgttaagagtcatcaccactccccaatctcaagtacccagggacacaaacactgcggaaggtggcagggccctctgcctaggaaaaccagagacctttgttcacatgtttatctgctgaccttccctccactattgtcctatgaccctgccaaatccccctctccgagaaacacccaagaatgatcaataaatactaaaaaaattaaaaaaaaaatggcaaggattaaaaccatgacaagaagattagaaagggtattttcattcattattagtggggggtgtcaacttgtactaacttttcaaaaggcaatttggcaatgtctatgaaagttcaaaacgtgcccaccttttgaaccagacactctagaaatgctcaccactgtgtacaaagatagatgacaagataaaaaaaaaaaccaggtactgctgaggttgtagagaaaagggaatgcttatacactgttggtgggaatgtaaattaactcaaccattgtgaaaagcagcgtggcaattcctcaaagagctaaagagagaattaccattcaacccagcaatctcatcactgggtatacagccaaaggaatataaattgttctaccacaaagacgcatgcatgcatatgttcactgcagcactattcacaatagcaaagacatggaatcagcctaaatgcccatcaatggtagtctggacaaagaaaatgtggtacatatacaccatggaatactatgcagccatcaaaaagaatgagatcaggccaggtgcagtggctcatgcctgtaatcccagcactttgagaggccaaggtgggaggatcatgtgagcccaggagttcaagaccagcctggacaacataacaagacctcatctgtagacctcgtctctacaaaaaaataataataacaattttaaaaagaacaagatcatgtcctttgcagcaacatgaatagagctggaggccagcaacatgaatagagctggaggccattatccttaacacactaacacaggaacagaaaactaaatactgcatgttctcacttataagtgggagctaaatgatgagaactaatggacacaaagagaggaacaacagacactggggcctacttgaaggtggagggtgggaggagggagacgatgaaaaaaaaaataaccattgggtttagtaccttggtgatgaaataatctgtgcaacaaacccccgtgacatgagtttacctatataaccaacttgcacatgtacccctgaacctaaaataaaagttaaagaaaaagacgacaagagagatcactgccacactgtagcagaaattacacagaagtccttcaatatggggctgattaataaatcgtagtacatgcatacaagaaaaaaaagcatctcttaaaaatatctctatgtcctgatactgaaataccttccatcaacaagtgttcattaagtaggggctattccagctatgccagtgagcagctgtgcaagcccatgcaatctgcttatccactctggtactcagcttccttagctgtaagaggtagataaaaatggtacctacttcctaaggtcattgtgagaattaaaagtgatcatgcatatataatgcttagtatggtgtcaggtgcagtgtgagctcactacatgtcggctcttgttgtgtcacttttgttatcgttatcatttgtattatcattatcattaccactatgaccattattaatactattctggaaagggcaaatggaatggcaaaacagttttacataatgagcagattttagcaaaacgaagacatttacatacgtatatatttatatgtgtatgtaaatataaagagaaagaacaagggggagagagaggtgtataggtggaaattaaccaaattcatcagaaattggttatttggaatgagtggtgatatgagattataagtgaatttcccctttcagattgtatattcctcaagagtttggatttttggtgtgctacttctaaatcacttctgtaggaagagaaaaaaatgacaaaataatatagactttcttaaaaagggcagaagggaaagtactgaacacgcttagggacatcatgaattctgagcctaaaaaggaaaagggcagacctttgggttgctcaggctgttctgaaaccccagatgtggaaaaactacatatagatcagaaaagaatttgaagggcatgaggtttactgattcttcctgatgatcaaggtccatatattgagccagaacataagagctatttgtgcagacatggctttgatttcctgaagagtcacatatttttagttctgctttagcaggacacctttggttgacatgcagacatattttaagtcacagcagagcaatcctatctctgtatttatcacaagattgctgataagggacttggctgacgcatcagagaactgtcttatcaaagaaatctttgcttctgaggaagtggcttactttctctgtatgggtgagataaataaagcaaatgagcttttttccccctctatgttgtggcttctaggaagctcagaaaaataactgtagctcaacataattatgtagaatcctatgatctacatatagacatttcaacctggccttggttttgctctacttccctattcctttttatgtgtttatatgtatccattttatggtattaataataatataataataatattaaactcatatataagacttacgtgtgtgccaggcattgttgtaaacacttatattgactcaattgatctacacaacaaccatacaaggcaggtattattattattatcattaacatcatcatccctattttacagttagagaaactaaggcacaaagaggttaaatgacgactctgtccgcagaccaccagccctctcacttccgttcgatgtaaactctctgccctgcctcataccctgctctgatgttaagatccgaatgcttattcaggcaaggtccccttgtgtttccaaaatcagtcacaacttcctctgacagccacctttttccgacctttatcctgcattaggtactgccagtcactatacttgctcatgcgcagtaccgttcccaaagccgtcggcactagcagccaaagtttctttcttatgataatggcattaatcacttcctaacagccccacctctcaatattgttacaatggcaattaaatttcaacacgtgttttggtgaggacattcaaaccatggcagtcatactgccttcttctcttctgtctgtgtcagatctccctgcctcaatctgataaggacactcattattacatttagggcccacccagataatccaggagaatatccccttctcaggatctttaacataattactttttatttttttttttgagatggagtctcactctgtcacgcaggctgcagtgcagtggcatgatctcggctcactgcaacctctgcctaccaggttcaagcaattctctgcctcagcctcctgagtagctgggattacaggtgtccaccaccatgcccagctaatttttgtatttttagtagagacgggggtttcaccatattggccaggctggtcttgaactcctgacctagtgacccacccacctcggcctcccaaagtgctgggattataggcgtgagccaccatacctggccaacataatcacattttttgttgtaagttaacactcacaggttccaggggttatatgtcgctatcttttggaggggcgttgttcagtctaccacagcctgccctctggcccccaagtattcacatctctcccacatgcaaaatacatgcgccccatccccaaatcctcaaatgtctcaaaccgtgcaacgttagctgaagtccaacatcttatccatataagatcagctcaaaagtaccaagtctcctcatctaaaacagatatggatgagactctggttgtgaaacatcctggggcaaaattctcctgccatgaatttgtgacactagaaagcaagctatctgttccaaaaatactgtggcgagacaggtgtaggaaaatagttacggatatttccatttcaaatgggagaaactggaagaaaggaaggagtcactgctcccaaccattttgaaatctagcaggacaaattccatttggtttcaagggttcagaataatcctctgtagcttgaagctctcccctctggtcccatagccctcctctcagaatgtatgtcatagtgattcacacccttagatcagcaggtccttttgtatctttcccagataatatcatttctattagcagctatggctgagcatagtggaagagctccttgagtcacgtgcctgatctcttcagcactagcaaacatagacacattcttgacattgtctctagagcataccttcctgacagtgcctctcctaattttagtgtcttttgcaatcttgataggctgagaatttccctggaccttttttgcttaacagtcctttcctcagtttatccctttcctctaacattttactagtgcttggattggagtccaatataaaaatgaaaaatataggactaagatgggaggtaaaaaaatgatggactttctaggcaagttgttgaggttttctgaaggatgagccttgggaagggagtcttatatatgatcagattggtgggattaaaaagaaattttttatcagtttttctaaaaatccaacattagtgtcaagtgtgcactgaagcagggcgagtctactcctctaggtttgaaataggttttcttaacatgttgatctgtttttctttatcttttaaataacctgtctgaaaaaacagggattttgtgttttaagatagtttcctaactgcatttattaggtttttgtttttgtttttgtttttgttttctgagatggagtctcactctgttgcccaggctggagtgcagtggtgcgatccagccactgtagtaagcaaggttgctcactgcaacctccacctctcaggttcaagtgattcttgtggctcagcctctcgagtagctgggattacaggtgcccaccaccacacccggctaatttttgtctttttagtagagatggagtttcaccatgttggccaggctggtgtccaactcctgacctcaagtgatctgcctgccttggcatcccaaagtgctgggattacaggcataagccactgcacccagctataattagcaataatataataaatttagtttgtacaatggttttgaaccaagatcccaagcctaggggccaccagctaaacaaatcacaagactatggggcaattgaatgagacctcttgcagtctttgagtagcattttaggactgggttgaattaaagtagagtgccgactctataaaagggaccactaggtgaaggaaaggatttgggggtcaggttctgtcaagtgaaaaatgtagacattaaggggataagagtcttattatgatatgaagagtaattctgacatcttgggaaagctgtctacagtgtggaaacatcaatttctcatcctgatttgttgttcgaatgtctctggttatggcattggacagtttggtgaacttttcgtttggtccatacatcaggcacaagacttgttccttaaaatttatgcacttttatcttataggacttgtaaatcaaaaataaaatcctaagccccctgcccccaaccatctgaatagactccctcctaagccagggatcttttaaaatttaacctgagagacggtttcaggccatgacaggaagtgggggtcaggcatgcctcattatacgtctctggcatcaacatcaacacagacttgaagtctgataagaaacatgttgtccgggcgcggtggctcacgactgtaatcccagcactttagggggctgaggagggcggatcacgaggtcaggagatccacaccatcctggctaacacagtgaaaccccatctctactaaaaatacaaaaaaattagctgggcatggtggcatgcacctgtagtctcagctactcgggaggctcagtcaggagaatcacttgaacccgggagccggaggttgcaatgagcagagaaggagccacttcactgtagcctggcaacatagtgagactccatctcaaaaaaaaaaccaaaaaaccaaaaaacaaaaaaaaaaacaggttacatgttacaacctattctctctggagcatagtacctgaaggcttcctccacaaataagaacttaaaaacaattaagaatgactcacttcacataatcagctttcacaatggttaaagcagagtcctgcttagcaatgcacaaaaattctcctttgtgacccattcattttactgctgttgactttcttgcttatgctttcagacagagtcactgtcctttgaccagacttgagtcgggctcctctgagtcctgtttctgactaggtcccaacctcgggctctgtccttcatccagggactctgcccatttagcctgtttcagcaaaagtcctatcaagtctgtttagccagaatccccctgcacctgaggtttcctccaagtaatttcccatcttctgaccccccgaccctactccttgactacaaatccccacttgtccttggtggagttgaagtcgatcccaatatcactctcccaccgcaagaccccattgcggtggtccctgtacctatcacagtagtcctgcctctgagtaaagtcatccttacgatcttttttttaattttcagagacaaagtctcactctgtcactcaggctggagtgcagtgacccaatcctagctcactgcagcctcaaactccagggcccaagcaatcttcctgacccagccttctgagtagctgggactacaggtatgcaccactaaatgcagctatctttttttttaattctctacagacccaggaacttgatgtgcccggcagatttttctactttttgtagagacagggtttccccatgttgcccagactggtcttgaactcctgggctcaaccaatcctcttgcctcaggctcccaaagtcctgggattacaggcatgagccactgcagctggcccttccttacagtctttaataagtgcaataaatacttgtttgctttaacatttccctgtgtcttcagtctcctgaagtgttatatgcctcacatttccttactccacccgatataaaaattcctttctttcatcgggtgcagtggcttacacctgttattccagcactttgggaggccaaggtgggcagataacctgaggtcaggagttcaagcccagcctggccaacatggggaaactacatctctactaaaagtacaaaaattagccgggtgtggtggtgtgcacctgtagccccagctacccaggaggctgaggaggagatttgcttgaacccaggaggcagaggttgcagtgagctgagatcatgccactgcactccagcctgagtaacaaagtgagactctgtctcaaaaaaaaaaaaatccttctttcaacactttggcgttattacaccattgtttccttgcctccagtgtggtgtttgagagacccgatgtcagtttaattatttttcctctgtaagtaacctgttatttctctctgatagtttttaaaatattttttccttgtctttcacaattttacatttcactgttcctgtgtgtgtactataatacttttaaatcttaaatcatttttctaaatctgagaaattctcattcattacttatttaagtacactctcctttttagtgactatattctcttcttataaggctactattagatgtgttttgacatttattcttctatcctccctattaattaacttttctttcatttacttcttctctatccattaccgattactttcatgaattctttagacgcatttcctcagctcagtaattgctttttcaactatatcagttttaacatccaatctattccgctgaattatttatttgagtagttaatgttttcatatccaatctatccaataggtt[135 bp omitted]agcctcttgggtagctggaaccacaggcatgcgacactatgccaggctaatttttgtatttttagtatagacgtggtttcaccttgttggccaggctggtctcaaattcctgacctcaggtgatccgcctgcctcagcctcacaaagtgctgggattacaggcgtgagccacagtgcctgtcctttttttcttttcatttattttcttttttaagacagagtttcactcttgtttcccaggctggagtgcaatggtgtgatctcacctcagtgcaacctccgcctcctaggttcgagtgattctcctgccccagcctcctgagtagctcgggttataggcatgcaccaccacattctatcattcattagcatctgtatcccttccttgaacaccaaaagaacttctcttttctttcctgtccctcctcccatcttccaagtttatagtaccgggaattttggttcaagactgtaattttttaaatttacaatctaaagtttacacttttcaatacattttactatttttctcctcaccattgcttactgaaatcacctccttcctcctaaatttagttttcccttctcatagaactgtataccaataattttttctggagggtatatgtgtggtgagttttctgaaatattttttcccttattctggattatcctggctgtatatagatatctaggttcagcatttttgtttgcttgtttttgttctcgttttgttttttttgagacagtgtctgactctgtcacccaggctggaatgcactggcaccatctcggctcacagcaatctccacctcctggactcaagcgattctcctgcctcagcctcccaagtagctgggactacaggcacgtggcaccacacctggctaattgttgtattttttgtagagatgggttttgccttgttggccaggctggtctcaaactcctgagctcaggcaatcctcctctctcggcctcccaaatgctgggactacaggcgtgagccaacgcacctggcccaaagttatctttaatcagctccttgaaaaacttcttcattgcattttctcttctccctttctctctgggacctttcaggattttatctttatcctagaaattttactcctagggtgtgggggggggcagagggggggtgcatgcatgtgtgtgtgtgcacatgtgtgttaatcaagctgagaactaggtggctcttttcaggtcaagattcatgtctttgtttagttgagaaaattctagaacattatttcttcaagtactgccttctctccagtctttatgtgtgtgtgtatatatatatatatatatatatatatttttttttttttttttttttttttagacggagttttgctctgtcacccaggctggagtgcagtggcacaactgcagctcactgcaatctctgcctcctgggttcaagtgattctcctgcctc[134 bp omitted]gacctctcaaagtgctgggattacaggcgtgagccacggcgcccagtccagtctttttgttctctacctttggaacttctattggatgaatgttgaaacttctgggatctattctccatttcctttattattttcatttcatactttctattttgtaatccttctccgctataaggtgatgtagtgccgtgcctgaacacgttttttcattgggttgttccagtttcttttactgatatgcgaaagctttgttatatattagagatggttacttttaatttattgcggatccttcaccatttttcccaaaatttgccttttaaaacagttgtttatggtgtcttttgacttagatgatactttaatttctacgtctttaactatgtcagattcattgttcatagccttggagtaatgtcaggaagtgcctatgccaactcaagatgtcttacactgtaatattttcctaaattttcatctagttctttatgacttcacgttttcacatttaagtcgctgaatttatagaatttattattttatgtggtttaaagtaaggatttaatctttattttttcaaatggatagacacttgtcaagcaatcatttattatacaacccatcttttgcccagtgtttggaaatgcatgctgaagtctgcacataaattagtctgtttcttgattttctattttgtttcactaataaatctgtttctatgtgtattcattttttattgttgctgcaacaaattggcaatagctaatacaatgctgggcctgggggctcatgcctgtaatcccagcactttgggtggcctaggtgggcggatcccttgaggtcaggagttcaagaccagcctggccaacacggcaaaaccccgtctctactaaaaatacaaaaatcagccgggtgtggtggcacctgcctgtaatcccagctactcgggaggctgagaaaggagaatcccttgaacatgggaagcagagatagaactgagccgagatcaccccactgcactccaacttgggccactaaagtgagactccgtctcaaaaaatatatatgtagctaagacaagttttgaaaaagaagaataaggtgggaggaatggctctaccatatttgaatacttcttatatagctacaggaatcaagactgtagtattaggagaagaatagacacgtagatcactggaacaaaatagagaacctatataagaacgtagaaatagccccacactgattttttacaaagagacaaaaagaaggaaggatcgtctgcttaacaaatggtgctggagcagttgcatattcataggccaaaaaaaaaaaaaagacctttatacaaaaaaaaaaaaaaacctcaagtgaatcatagatttaaatgtaaaatataaaactaaaaaaaaactttcacaagaaaacataggagaaatgtctgagatctagggcatagcgaacggttcaaaaaacataatccataaggaaaatataaattagatttcatccaatttaaaacttttgctctgcaagaaaccatgttaaaaggatgaaaaaacagggtataaactgggagaaaatgtttgcaaaccatgtttccaacagagggcttacatccagaatatataatggatatgtatactactctcaaaattcaatggtaggccgggcgtggtagctcacacttgtaatcccagcactttggaggtggaggtggatggagggtagatcccttgaggccaggagttcgagaccagcctgggcaacaaaacccatctctactaaaaataccaacattagacaggcatggtggctcgctcctgtaatcccagctatgcgggaggctgagacacgagaatcgcttgaacctgggaagcggagattggagtgagccaagatcatgccactgcattccagcctgggtaacagagcaagactctgtctcaaaaacaaaacagcgggaaaaacaaacaaacaaataatccaattagaaaattatgaaaagatatgaacatacatttcactgaaggggaaataagcaaataagtacatgaaaagatgttcaacactaatttgcttcactagatacaaattaagaccatgatgaggtatcacaacacacttattacaacagctaaaataaaaggcatagtgacaacaccaaatgttgacaaggatgtagagaaaatggacatctcattaagtgctgctgggaaggtaaaatcttacagccactctggaaagcagtttggtagtttcttataaaactaaacatgcagtgaccatacaattcatcaattacacttcagagaaattaaaatttatgctcatccagaaacttgtacataattgttcatagcagctttacttgtaatagccaaaagctggaaataatcaatatgtcctacaataactgaatggtcaagctgtgatacattcatcccctggaatactactcagtaataaaaatgaaatattggctgtgtgtggtggctcacacctgtaatcccagcactttgggaggttgaggcaggtagatcatgaggtcaggagttcgagaccagcatggccaatatggtgaaaccccatccccatctctaccaataatacaaaaattagctgggcgtagtggcatgcacctgtagtcccagctaatcgagaggctgaggcacctgaatggcttgaatccgggaggtggagtttgcaatgagccaagatcacacgactgcactccagcttgggcgacatagtgagattctgtctcaacaacaacaaaaatatgaactattgttacacaaatgttaatatcttggatgaatctctagggaattatgctgggtgaaacaagcctctaaaatgttatatactataagatttcatttgtacggcattctagaaaagacaaaattatagaaacgaaaaacagattagtggttgccaggggttggggatggtggatgggaagagactgggtattactaaaagtgagagcataagggatagcattgtggtgatggaaatggtgtgtactttttttttttttaattccaagatggtgtctcactttgtcacccaggctggagtgcagtggcaggatctcagctcactgcaacctctgcctcccaggtttgagcctttctcctgtctcagactcccatgtagctgggactacaggcacgtgccaccacgcctggctaatttttgtatttttagtggagacggggtttcaccatgttggccaggcttgtctcgaactcctgacctcaggtgatctgcctaccttggcctaccaatgtgctgcgattacaggcatgaaccactgcacctggccatattctgcatcttttttttctgaaatataagctttattttaaatttaaagaaatattaaaaataaactttttttttttttacaaattataatcaagcactcaaaacagtttaggaattttaaacactaattcttaattcaaagtaatgacatccatagaatacatctggcattggccaatatgaagtttacttaatattggtattttacggacacaggaaggggaacatcacacacaagggactgttgtggggtggggggaggggggagggatagcattaggagttatacctaatgctaaatgacgtgttactgggtgcagcacaccaacatggcacatgtatacatatgtaacatacctgcacattgtgcacatgtaccctaaaacttaaagtataataataataaagttaaaaaaaaataaaaattaaaaaatatattggtattttacatatgattaaccattcatccttcctaaaagtcaatgataacagtgatttgactttacaaaatgaagccttttatgtaataccacagagataactttttcaaatacaaaacctttataccagcaaggaaattataaaaacatatataaagtatgctgaaggacgtgatttaaaggttgtctgtatatatagatgtgtttcaccttagaaagtacaaatgcacatcaaaacactttcactgaatatagatgccattacattctcttacttacattacgaagcaaaaggcacgttcataaacgttttattacgtattaactgaaaaaaagcatacattccacaaaaaggttttgaagacacgtgggagtggaatgtgcccacattaagagtcgagcttctacaggaccacctgtctccagcagagaccactgaaaacagctgctaccctcagaaagacaagatggtcttgttaatgatttcaatggactctcgaatctcatcctccttgatcaccagtggaggcgcaaacctgatgatgtcaccatgcgttggcttggccagaagttcattatctcgtgtcatccttgcgcaggggccatgctaatcttctctgtatcgttccagttttagtatatgtgctgctgaagcgggcactagaagtccattatcttgaagtcttacacacaccttccaagcatcacaatctttggttcctttaataacaatagcgtttaataattcctttcctcgctgggcttggtggctcacacctgtaatcccagcactttgggaagcctaggcaggtggatcacctgaggtcaggggttcgagaccagcctggccaaaatggtgaaaccccatctctactaaaaatacaaaaattagccaggcatagtggcccgtgcttgtaaacccagctactcaggaggctgaggcaggagaattgcttgaaccgaagagatggaggttgcagtgagccaagatcgcgccattgcactccagcctgggcaaccagaatgaacctctgactcaaaataaataaataaacaaacaaataaataaataattcttttcctcttatggtagtcacaacatcggaaggtagcttcatgcgttcatttctcaagagaatacccatttttttctgcattttcagcaaggttttcttcttctaaaacctcaagggctgcgatggtcactcagcagcctagtggattgccaccgtatgtggacccacgttcccctggcttaatggtcagcattacgtcatcatcccacagcatcgcagacagagtatcagcccccagaaagggcctttccaaggaggactatatcaggtctgacattttcatgatcaacagccagccatctactagttctggccaatcttatctgtatttcagtggcaataaacagaaccaggctgggagcatgagatgggatgaggctaagttaaaattccgcaaagcttactgttcttacagagattcagctggtttttctctctttctttctttctttcttgctgacttgctttctttttctttccttccttccttcctttctctctctttctcttttctttctttctttccttctcctctctctttctttccttcttctctctctttctttctttgtttctttctttctttctcttttctcttctttctttcctttctctttttttctttccaggcagtcttactctgttgcccaggctggagtgcagtggtgtaatctcagctcaatgcaacctctgcttcccgggttcaaatcattgagtgagcccaggaggtagagaccagcctgggaaacatagcaaaaggcagggtggtgcaggcctatagtcccgaggctgaggcaggaggatgacttgagcccaggaggtcgagaccagcctagacaacatagcgaaactgtctttactagaaaaattaaaattttagtgggggcgggttggtgtgagcctgtagtcccgaggccgaggcgggaggattgcttgagcctaggaggttaaggccagcctggccaacatagcgaaacctggtttctactaaaaaaaaaaaaaaaaaaaaaaaaaaaaaaagagcctgggcagggcggtgcatgcctgtattcccaaggccgaggtgggaggatcgcctgagcacaggaggtcgagacaaacctggtcaacacagcaaaactgtttctactaataaaacaaaaataaaaatattagtgggggctgggtggtgcatggctgtagtccagagaccgaggcgggaggattggccaaggaggatttaaccaacaccacaatcacatcccataagtaaataccttttcctctctccagggctacaggtaaaggatggtaattgtgcgcaccatgcttagattccctttcaaaaatgtaatcagaggttggagggccttggacggtatttttagttccaagagatgtagaagccagtgaagtatgaactccacgactaagtacagcaaagctccacaaatgtgctagtttagaaaacattgtgtccttcaagtagaaaaaccacagatcgactatttttttcttcccacggttcagactagaatacagatttttaacccaagatccagggacggtcttgagagagatcaaaatctcctgacggtgcccgaggaccacccactttgtcgcaatggcaacaaagtgtggctggaggaggagacaatgttctgcaatttcactgcccaaggatgatggactaatcagggcagttagtgaactccatctggccaatcagaagtcagaagagtaggcgggaaaagcgaagctgaagtggtgtctatcagttcaggctccagggacagaactttcccaaaggaggcgtgggggtggggagcgggggcgggcgcagggcgaagacttgattttcccacctaaagcatcccctgggattggctacttcaagttcagagtacgcatgctctgatattctctttggattcttccaaaatcagagtacgcatgtgctgattttctctttccatttttttcctatccctccccacccacccccccacagtgcatttgttatccagttttaataagtagtgtatatgaggcaggtcgccacctcaaatccttcctgtcagtttctcactttttcaggtacgggatttttactagcaactctgtagtaacctaagaaaattgggccaggcgcggtggctcacgcttgtaatccctgctcttttggaggccacaggtggcggatcgcttgaacccaggagacagaggttgcagtgagccaagatcacaccactgcaccccagcctgggccacagagtgagaccctgtctcaaaacaaaacaaaacaaaacaaaaagctcactcaaatcattcctcctgggctcaagcgatcctctcgcttcggcctcaggactacaggcgccgaccaccggcccctgctaatgtttttttgttgttgtttctttctttctttctttctttctttctttctttctttctttctttctttctttctttctttctttctttttctttctctctctctcgttctctctttcttttcttttctctttctttctgtctgtctttctttctttctttcttcctttctttctttctttcaataaagacggtttcgctatattgaccaagctagtttcgacctcctgggctcaagcgatctgcccaccttgtcctcccaaagtgctgcaatgtcacaggcctgcgcctacatccccagctaattttttgtatttttgttagacacgggggt[133 bp omitted]aagtgatggcgggctcttgtagtctcagaaattctagctctcttcgttctaataatttacaaatcacccagtaatagcctctaaacccatttatattagccatgctcatttctcttcaacagaacagaaccccccatccctctgcctgatcagatccatcaccagagagaccatgttatctctgggactcacttcccttcctttatttattgagtgggggtgtcagaacgcccccactcaataaaattacacagtcacatctcggcctccccaacaagggtctgtacgtctttcagggtaagcctagctccagggaaactactaacgacattagccaaccccctcccaaagactcaaggctgctttgcccatagggaacctatcatccccattcgatacttctcccagagacccctggttccctgttttcatctgacttctctccatgtccctactcacggacagataagccctggatggagaaatgcaacacctgattccaggtgactgagtgtggccggacttcactgatttctccctccacaggaccaaaggtcctgcagctggaaagactcaggctgtttctcttgcaggtcagattgctcccagtgccacgaatggagacgacgcctttgcaaggagacccagggttggttctcaaataccagagaacatgcaaaaggtgaggagacctggagggggcagagcagtggcccaggggacagtgtggggtgatcagatttctgaggaggggaggacagaggtactggggacaaggagcagggtctcgggggagatctggacccttgggagcctcccaccctcgctctgtcatcacctagcatccctggagacaagtctgtgaccttgctctacatttggtaactctcactccattctgcaaggtgagaagagagccagccagcagcattgaagccctactgtgtggcaggggagaagctagggaaggtccccatgttctgtcagttagccatggcatcaaccaggacggattatcatccccaattcccagatccagcacacaggaaatggctccagctaaatggcagacatgcctagctgagtccctgccagaattccttttttttttctaggtcttcgatgatattgccaaatatttctctaagaaagaatgcgaaaagacgaaagcctgggagaaaatcatctaggtgtatatgaagataaactatgaggtcatgactaaactaggtaacagaaaattcttggtacagagaagtctggggacacatgagcatccctttttctgctttggctacttcttaggctgctgaaagcaccccatattttccttttgtgcagggaaaaatctcaaggcagcttctgggtgttctgctcttctgtatcctgccagggctgagggcagggactagccacagtggagctcatacctggatcctgctcgtttccctcccttagatgtctgttctgacgagtccagctctctctgtggcatcccagcacacccccaccaaccctaccttccttctcttggcttgtctttctttctttctttctttctttctttctttctttctttctttctttctttctttcttttttttttgtgtgtgtgtctgagtctcactctgtcacctaggctagagtgcagtagtgcaatcatacctcactgcagcctcgaagtcctgggttcaagcaatcctcctgcccagcctctggagtagctgaggctacaggcaggtgccaccatgcccaactaatgttattttatattttgtaaatacgggggtctctctatgttgcacaggctcctcttgagctcctggcctcaagttttcctccatcctcagcgtgccaaagtgctggtactacagaaatgagccaatgtgccaggcctaagcttgcctcttaaggaataaacattttctttctttctaggtttcaacgtcaccctctcacctttcatgcgtaataaacgggctgcagacttccaggggaatgattctgataatgaccgtaaccatgggaatcagggcaagtagataggaaggggctgtaaagagtctcctcaagcccaactgcttttcagctcagctcagctacctgggaaagacctttttttttttttttttttaagttgcagttttcctctcatcgcccaggctgctgtgcaatagctcaatctcacctcaatgcaactttcacctcccatggtcaagcgattcttctgcctcagcctcccgagtagctgggattactggcgcctgctcccactcccagctaatttttgtatttttggtagagatggggtttcaccatgttggccaggctggtctcaaacttcctgacctgaggtgatccacctgcctcagcctcccaaagtgctaggattacaggcgtgagctcccactccctacctgtttgtagtatttctaatattctgaataaataaatcaggtctaacatagctgtggggtaatgttgagatctgactggaatcaatattattccctgtacttttctgtgtgtttgaaatatttcttttttaaaggacatgttgttcttgctaagcactgttaatgaatcaaaggacagttaaaatgttacaagtgcaaaaaaaaaaaaaagaaaatattaaaagtgcagatccgtaaaaaacttcctgagtttgtttcattaacagcatgtaggtattggataagtatcttaagagagaggatgatgaacacattatgtaaggaggatcgctgtttctctgtattttatcaaaaccaaatagtcttctcattttcaaacaaccctgattctccgtgatgagcttggaagtgagtttgaaagtgtgatcccccatccaacacacagagagctttcccacttctcagtgagcagagataacacagggtgaaaaaaagacaggttcttcggtagagatctttgtacatttcagggatataaaggggacatatgtgtttgctggttcttctgctctgacaacacaattataaaacaaagtcagagtgtctaaactgtcttcaatagacctattactccccaaccaaacaggccagattctacaatctcccacagtcactataagagatctgaaactccagtgcttgagtatctgccaagtttttgacgttaaaggagtgtcttcataccgaaaaaatttcagagccactggactaaatcatcgatggttcatcacacatttaacagcttaattcacataccataagatccacccatttgaagtgtacagtgatttttagttgttcacatcttgggtggatacagttcaggttcccaaccaatcgatttaattttttgggaaaaagtaaaagatacgtaatggaataagatgagactgtgatggggtttagtccccatttggtaaaccatgagatggaaaattctgaattgatgccacagataaatgaaccaaccatgactaaacataattcagaagcaaaactgaaataactcctcaacaatgagtggactcataacactctgctgcagaataccctcatgcaacagaagtatctctggagtttggaaatctttaccaacaaagaaaaattctaatgtattctctttcagttgaacgtcctcagatgacttttggcaggctccagggaatcttcaaatctaaaggattcaaatctctcaaatctaaaggaccagagaacctttgtccctccatggatgcgaacactggtaagagtgggagaatatcaaaaatgccctcactgcctccttctccccatgtctatcacaacaccagatgcagcatcaacagcttgataatactaacagttgtgatccttaatacttcttttgttttcacagtgatgccagatattctaagcagtttacatggattaatttatttaatccttaagaagacctctatgacattgtttctattattatctccaaataataacgtgtcatacacttcagttgtcatccacacaagagccatgtgacttggcacaaatcttctaaggtctctgagatccagattcctggtccatgaaatggaagtaaagaatcatagttcatgttttagatcatagttatcagcagcataataataaaatgaggctatcgtggtatagaggtgttacagaattttcctgaggcgcagtggcagtggtagtctaatccagagctccaagccatttaaagctcattcacgtttgcatgtatttatgaagttcagatgttgctcactagggcttcaccccatagggcctcctggtgcttccgttgagacacccactctcccaacaggaaggaccagctggcctctgctgtgttactggggccacttgcatggcttaagaatcgctttgaatgttggcccctccctactgtgaggtcctagatggacttgtgtgcacctggggcatctgggaagccccagtcccagcccaggggatccattggaggcccctgaatgagtgaccccacaactgcagattcaactctggtttagagggtaaggggatctgggagttgggttgcctgtgtggagaccaaattcaaaggatcatgaaaggtataagttcttactattactacatttaaacagtgtttgcaagctcagagaggactttcccttagtctattttacatgtattgttcactatttcataggtgaggaagctgaataaatgtagcttaagactgttggtcagtgacacatccgaatacaacaagaattggtgtggataccacctcacttaattccatgttcaattttggtgcgttggtagggtgttatgccatatctggtactgctttctttgctgcctagattaatctcagcaaaccatttcattccctctcccttccctgtattcatctccccacaccatcttttccagcagtgctttgtcccctctttatgtttccacctttactctcctagcagctgtctacaagtttatatgggatcccttgaattttatagaagctcttccttttgtagaccttgtgaattctcagaatgctattctccaaatcttctgtataccacactctcaattacatggagacttttgctgtttgcaagaatgtcagtcttaaaagagtgtgaagataatcattctatccctggaaaccccattcactaccaagtacctcttagaagattaacaagagatctggtaagaggaaacaattcgggaacaacccctctggcttccctggtgatgttcaggtgtatggactgggtgtgtggcatggatcccagacaagcctgggcccaggctgggctgaggagctcacccagctccagatgagatgttggagatgacttccagagacatagactggagttgtcatccatataaaaaaccacgtgacttgggggcaagtcttccaaattttctcagctccagattcctagtccataagatggaaataaagaatcatagttcataaattgtttggaggcattaaattaaatcctgaaggcctgatgacatgaaaggtgctcaagcaattctatctgtgattacctgggatcatatcttactcagctcaatgcctgatacccaatacaggtgtacttcagtgatattgcaggttcggttccagaccactgcaataaagtgagtcacacacattgtttttcatttgttttgcagtgcataaaaactttgtttacactatactgtagtctattaagtgtgcaatagcattatgtctaaaaatgtacacaccttaattttaaaataatgcagtgataaaaaatgctaacaatctgctgagctttcagtaagtcacactctttttactggtggagggtcttgcctcagtgttgatggctgctggctgatcaaggtggtggttgctgaagggtggagtggctgtggcagttccttaaaagaacacaacaatgaaatttgccacattgattagctctccctttcatgaaagatttctctgtagtatgtgacgctattggatagcattttacccacagtagaacttctttcaaagttggagtcaatactctctagctatgaaagtcttagatggcatctccttccattacaaggctagtttatccatattgaaaatctgctgcttagtgtagccaccttcatcagtgatcttagctaaatcttccaaataacttgcagcttctccatcagggtttgctgcttcaccttgcacttttattttatggagatggcttctttccttaaacctcacgaaccaacctttgctagcttcacacgtttctcctgcagcttcttcacctctcccaactttcatggacttgaaaagagtatgggtcgtgctctgaattagactttggcttaagggaatgttgtggctggtttcttgttttatcctgaccactccaactgtctctatttgagcagtaattctgttttgctttcttattggtgtgttcactggagtattagtattattatttccttcaagaacttttcctttgcattatatagtattatttccttcaagaacttttcctttgcattcacagcttggctgtttggtgcaagaggccgagctttcagcctatcttggctttcagcatgcttcctcactaagcttagccatttctagcttctgatttaatgtgagagacatgtgactgttcgtttcatttgaacacttagcagccattgtagggtcgttcattgtcctaatttcagtgttgctgtgtgtcaggaaatagggaggcccaagaaaaggaggcgaaacagggaacagctcatcggtggagcagtcagaacacacacaacattaatcgattacgttcgtcatctcctgtgggtgcagttcctgctacctccaaaacaattacccacaacagggtgattatagtcaataataacttaatcgtactttaaaaaaacagaaagagtgtaaatggattgtttgtaacacaaggataaatgtttgagggggtggataccttattttccatgaagtgattactacgcattgcatgcctgtatcaaaatatctcatgtaccccataagtatatacacctgtgtacccacaaaatcaaaataaaaattattttaaaagattaaagaacaacaaaacaattgcaatcataatatcaaagctcaccgatcacagatcaatacaacagatataataataatggaaaagtgtaaaattggtgagaatttcaaaaaaaaattgcagtatctgtgaagcagtataaaaatgaggtgccataaaacaaggtatgccttgtgcccttaacaaatacctgcagcacaaaaggaggtatgggtgaatgttcccgtaagtgaagaggttgggaatctaaacctctcaacggtaggagccagaagctcaaactttcattggcatttggcctgtattggtatgggtcaaagttgtcagcctctgtaagccagcaaatgtgaaaaactggatgaagaaggcccacgggcacttgggaggggggaggcatctcctttttgtgagaaaacagagcctaacactctccaacctacccaaccctcatcttccaacttttccccatcataggacccaaaagggggaaacatgcctggacccaaagactgtgtgatagaaagcagctggtgatttatgaagagatcagcgaccctgaggaagatgacgagtaactccataagtgaaccttcggctcaccccccacatccctgcagatgtactattctgttatggtactggtatcccatcttgtcacttgttccccaaatcattcccttctcataattttctagggtacagcaatcaggctgatggaagagatttcccatgctctttctttctttttcttttgtttttcaagggagtcttgctctgtcacctagcctggggtgtagtggcatgatctcggctcactgcaaccaccagctcccgggttcaagcaattctcctgcctcagcctcctgagtagctgggattacagttgcgtgccactatgcccagctaatttttatatatttggtagagacggggtttcacaatgttagtcagtctgttcttaaacttatgacttcgtgatccgcacaccttggcctcccaaagtgctggctttataggcatgagtcaccacgcccgggcgattttccatgctctttctactccctgccctgtatatacagggatcctccctacccaggatgctgtgggttcccaaaccccaggtcagccctgatatgcaggccacacataggaattgataacccaggcgaggaagtcactgatgcatgagcagatggtttacttcgaggaaccgtgaaaggcgtgtgcaggtcctgaggtagggcagaatcggaatgtgcagggtctgcaggtcaggaggagttgagattgagttgtcacgtggtgggaactcactgccacttactttccttctctcctcttgcctcagcctcagggatatgacacatgcccatgatgagaagcagaatgtggtgacctttcacgaacatgggcatggctgcagaccctcgtcatcaggtgtatagcaagtgaaagcaagtgttcacaacagtgaaaagttgagcatcatttttcttagtgtgccaagagttcgatgttagcgtttccattgtattttcttacagtgtgccattctgttagatattatccttttcattgatgagcaagacatacttaatgcatttttggtttgtgtatccatgcacctacttagaaaagaagtattgtcaggtattctctccatagaacagcactaccttcctctctccccagatgtgactactgagggcagatctgagtgtttaatttcagattttctcctctgcatttacacaccacacacacacacacacacacacacacaccaagtaccagtataagcatctcccatctgcttttccccattgccatgcatcctggtcaagccccccctcaatttgtttcctgttcagcatgtactcccctcctctgattccccatatcagtcactgacagttaatacacctttgcaaacgttccccagttgtttgctcctctcattaatgtgcgcacaggtctctgcacgtgtgtgaatatttctttaggaaagattcttagaagttgaattgctgtgtcaaaggagtcatttattcaacaaaacactaatgagtgtgttctcgtgctgagcgctgttctaggtgctggagagacatcagcgaacaaggcaggctgatgttcctgaccaccattccggaggagggtgtttccagttgtttgtttgtttgtttgtttgtttgtttcttctggagatagggtcttgctctgtccaggctggagtgcagtggcatgatcatagctcaatgtagccttgaactcctgggctcaagtgatcctcccaccttggcctcctaaattgttggcattacaggcatgagccaccacacctggccttcagtttttattttgatagagactatacacttcagtcctggagcaggattctgcagcaggtggttgggcaatttggccttcgctctctgaacaattttcactttctagggctgggacggtccatttgggagtatgtgggaggagacacagataaaatcgtcatctggggaacatggagggatgaggaagatgcgtgcactgtagaccctgtgatggccagggaatggaagagttcacttagtctccatgcaggggatcagtagtgggaaagtcctctggacagaagcatgagactgcccatcaagggtctcaccacccaagggcctgggggctggggtggggaccatgatttgggaatgggacagttctttctcacaggtaccactgcacggtgcagagggaaaagagttgtggggaagggaagggcagaggggagtctattttagaataaaacatttgtgtgtgaatggagacattaaagctccattcacaagcgatggacttgaaacaccagccccaggtggaggcaggattggagctgttttgaccgttcatggcccatcaccttggcctcctggttctccccagccttggaaggaggacactatcatcattatgcctatacgacagatgagagacagaatcccagagagatggtaggcatcttatcacaggtcctacagctggcaagtgcaggaggagctgagtttggagttcattgactcgaaacattaaggaggacaggagtgtggggtggagggagggagacttgaacaaccccagggttctgtccccagtcacaaggtagaggctgtcagttcgttttcccaagacaaggatcacttggacagagagagtgcagggagggagaggcaatcgtggccatagtggggacagtgggagacagagatatacagggtgggcagaagaggtggcaggcaaagaagcaggggatacccaaggccaagtgtgggctgtcacagccaccagagggagaaggtgccaggaaggtgtcaggaagtctctccaggagcaacagaggttccccagatctgtgagcatgccctacctggcacttcaggaaggggtggctgccacccaggtcagtgtggacgtacctctacctgtgtctcagaggaaacaaattctattttatcccaatatagttctgtattacacaaatgtagcattcagctactagatatcgagtgccttatcctccatgtaaatacagcagaggataccctaaaagagatactgaaggatttgatttttctttctccctgggaagattgagtccataagttgggtcccccagtccacaagacaggtgcaagaaagggtggctggaagattgtgagtcatgacagggaacatttttccttaggttccttgggtatataagattcccaactatctgtctatcatggacagataaagagtgaacatggtcccctctccacaaatgtgtttctctccttgattattactgtgaagggctggagttccatcaagttctgatacattactttattattattatcactattattattattgtgagacagaatgacactctgtcgcccaggctggagtccagtggtgagatctcggctcactgcaaactccgcctaccaggttcaagtgattctcccacctcagcctctcaggtagctggaaatccaggcacatgccaccaagcccagctaattttttgtatttttagtagtgacggggtttcgctgtgttagtcaggatgttctcaatctcctgacctcgtggtccactggcctaggcctcccaaagtgttgggaatacaggcgtgagccaccacaccaaacaatacttccattttttgtgtttttttgagacaggatcacactctgttgcccatgctggagtgcagtgttgcaattacagctcactgcaacctcaatcacccaggctcaagggattctcccacttctgcttccgaactagctgggactacaagtacacaccaccacacacagctaatttttgtatgttctgtggagatgggatcccactacattgcccaggctggtctcgacttcctggcctcaggcaatcctcctgcctcagcctcccaaagtgctgggatgacaggtgtgagccacctcgccaggccttcactttctttaacgaacaattatcagagtttcatcttagaggcaaaagtggctactgccggccaatctgagtgtggtgttggaggggaatctgggtgattcagacgtttttaatgaacttttaaattagcctacctgatgactatcctaaggccctttccagctccgtgtattttcgttcagggtttggagtttttttggaggctttgttataaagagcatctcttgctcaggcgcagtgactcacgctgtaatcccagcactttgggaggccgaagcaggcagatcacttgaggtcaggagttggagaccagcctgaccaacatggcgaaacacctgactctagtaaaaacacaaaaatttgccggccttggtggcaggcgcctgtgaatcccaggtactgcaggggctgaggcaggagaatcacttgaacacgggaaacagagggtgcggtgagccgagatcatgccactgcactccagcctgggcgacagagtaagtctctgtctcaaacagcatctctcgcctacagtgatttgagctgtggtcttgtctccttgggtttctctatcagtctgatctcatctactctgtctcccaggaatgcctcagtattcctggtggaccacttacacgctttcctattttcctctactgttaagaattgacccttgaaaacattttcatcccagttcaatggaatgtgagtggggcacgggatctatctgccatcttgctccaatcatctggttttagatatttatgtacttttgtcactatagacgtgtcttttttctcaatttgattttctaaatggttattactgatatgtagaaaacctatctattaccgtatataatattttgttacctgtctgggtgcatcttcccctgcattttggcacaggactcaatctgttttattctcaaaaaaaaaaaaaaaaaaaaactgatagcctgggtgtggtggctcatgcctgtaatcccagaactttggtaggccaaggtgtgtagatcacctgaggtcaggagttcgagaccagcctggccaagatggtgaaaccctatctctaaaaaaatacaaaaaaaaaaaatagccgggcctggtggcgcagtcctatatttctagctactcggacagctgaggcaggaggatcacttgaactcaggaggcggacattgtagtgagccgaggtggcaccactgcactccagcctgggcgacagagattctatctctaaagaaaaagaaaaagaaaaaaagaaaattcacttcacaggcaatagatagttataaaaggatattttatggaagatttcataggggagactgatggaaagaaagaagtatatattttacagagctgagcaattcactgcaaaaatcaccagaactgcctttttctccaaaattattacccataagctattctactactggttcttctagtccttctctctattccaaatcctcaaattgtccattttcttattgcaataattttcctctgtgcagatctaggtcctccacaacacttagcactctcttcgagtgtttgcatgcccgttgttttagctcaggttcccaaggaaacagaatttgggccattccggacacctctagacagactatactgagaaaccatgcctggaacggtgcatgaggagaggagagtagagggaatttacatacctggctctcactcctggttccttttcttaatggtcaaaatttatcccacaggcacgagctcccctacacttctagattgcatcatctgcccccttggcagctgtctgggaagccagatcccacactttgaagtgtagtgtttcatacactccaaaagtggtagcagaggccaggcgtggtggctcacgccagtaattccagtactttgggaggtcgaggaaggtggatcatgaggtcacgagttcgagaccagcctggctagcatggtgaaactctgtctcttctaaaaatacaaatttagctgggcagggtggcgtgcacctgtaatcccagctgctcgggagactgaggtaggagaatcacttgaccccgagaggcagaggttgcactgagctgagattgcaccattacactccagcctggacgacagagcaagactcaatctcaaaaacaaaacaaaacaaacaaacaaacacaaaagtggtagcagaagtcagaaagtccaggtatgtagctaattgtcctggttgtacatcagcagccaagggtgaaaactaaatactcccaggcaagtcctaagttcaccgagtaactggagtacccatctgtgttagttaactgcctttatctgaaggaaaaacaaatctcatatctctatgacaaccaggtgcttacagcttggaagaagtcacctaggctaaactcccttggtgacagggagacacggacatcatcttcctcgatgttcacatttcaaagagatggcaccaaggccctgaagaaagacattcctaggggccgggcatggtggctcatgcctgtaatcccaacacttttggaggctgaggctggaggatcacttgaggcctggagttcaagttcaagacattcctgggttctaggatggccagaggcttacgtatcaaaggaagaatttacaaacacaaattttctcaaggaaatgctctaaggaaggtgaaatggagaaaggtttcttcttcccttttggcaacaggaaaaattcatttttatgtttagttacccttacaatttcccccttttgttattgttttataggaacactgcaatattctaattatctccactgctgtttctatctttctctgtgtagtttacagccacctagatatccaacaagtccatagtaagatgcaaagctaagcaattatcaagataataattgaatgattttttttttcgagacggagtttcactctcattgcccgggatagagtacaatggtgtgatgtcggctcactgcaacctctgtctcctaagttcaagagattctcctgcctcagcctcctgagtagctgggattacaggcatgtaccaccacacccagctaattttgtatttttttttttactgttaattttttaatacctttagaattatgtaccagaattctatcaattgatgactcagttggatcatctttcaattttgttgaaagcaaaatattagaaaccagctaaatcacaaaaaaagttttttaactcagtgtcatctctttctcaccaatatttttaaatgtccctttaccaattgtctggagatttttttccaaagtgcattggtaagattcagaatggataagagatatatctttgttttgtcaagtatgaaaagaataatttttgttctgttttgtttgagatagagttttgctctgttgcccaaacagggattacaatggcgcaatctcagctcacggcaacctctgcctcccgggttcaagcgattctcctgcctcagcctctggagtagctgggattacatgtgtgcaccactacgcctggctaattttttgtatttttagtagagatggggtttcaccatgttggccaggctggtctcaaactcctgacctcaggtgatctgccctcctcggcctcccaaagtgcggggattacaagcatgagccaccgcacctggccagaataattgttttttttttttttcttcctgaaatattattcatttacttatctttgtgtcatccttctatttataaaattactttttttttcttttttttttctattatactttaagttttagggtacatgtgcacattgtgcaggttagttacatatgtatacatgtgccatgctggtgtgctgcacccactaactcgtcatctagcattaggtatatctcccaatgctatccctcccccctcccccgaccccaccacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcatattttatggctgcatagtattccatggtttatatgtgccacattttcttaatccagtctatcattgttggacatttgggttggttccaagtctttgctattgtgaataatgccgcagtaaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattatggttttgatttgcatttctctgatggccggtgatgatgagcattagagatgggatttcaccattttagccaggctggtcttgaactccttaccacaggtgatccccccacctcagcttcccaaagtggtaggattacaaacgtgagccaccgtgccctgcctagaaagaattcttaaattcagtataatactcaccttgtcagggctgggggacctttaaacacatcatagtggttaattgtgtcaaagtcaaaataaattgcagagagaaatccctaaatcaaatgctgtatttgggaaccacaaaattgcaattcaggacatacacacagactggagtggtcttcagtatgtccaacgaacaaacagaagttggaagttttattagaaataaaaatgttacgtattgttttgaaatgaggctcattggcactggagaagctggtttgtttgcacaatcagctttcacattccctcttttgatgaagatctttctttgaaaacctcactgatcagccgtcttaaagtgaggcttcattgtcactccatgccaggatggacccgtgccggttgtctttgtcccatgtcatgggaaaggtaagggagtctatatcaggaacatgggccacatttgagcaaaaaagaggtcagaaggaaaaaaaaaatcaggcatgtttgtctggagttcagcatcaaattccatcttattagtcccatctatattagcaatcatcttgaagcactaggccaacattatcctgttgggagaactggctgaacaaatattacacaggcaacaagaacggagctcaaagattataatacaaaaataattagcaatcgttttattttattttattttattgcgatgcagtcttgctctgttgcccaggccagagtgcaggggcgtgattccggctcactacaacctccatctcctgggttcaagtgaatctcctttctcagcctctcgagtagcttggattacaagtgctcatcaccatgcccggctaatttttgtcttttcagtagagaggaggtttcaacatgttggccaggctggtctcgaactcctgacctcaagtcatccgccctccttggcatcccaaagtgctgggattacaggcgggagccaccgcacccagctataattagcaataatataataaatttagtttgtacaatgattttgaactaagatcccaagcctaagggccaccagctaaacaaatcaaaagactatgggggaattgaatgagacaaccagtttggtgaactctttgtgtggtccatacatcagacacaagacttgttccttaaaatttatgcagtttggctgggt[133 bp omitted]gatggtgtcatgtgcctgtagtcccagctactcaggaggttaggcaggagaatcgtttgaacccgggaagcggaggttgcagtgagccgagatctcaccactgcactccagccttggcgacagtgtgagactccgtctcaaaaaacaaaacaaaacaaaaaaaaacaaaaatctatgcatctatgcagttttagcttataggatttgtaaaccaaaaatagcatcctaagcacccctgcccttaaccatctgaatggacgtccccctcagccagggcgcttttaaaattaacctgggagactgttttaggccatgacaggacgtgtgggtcagacatgcctcattatacctctctggcatcaacatcaacacagacttaaatctcataagaaacatgttacaacctagtctctctgaagcctagtacctgaaggcttcctctgcaaataagaacttaggttaccacaatcctttatcttaacccaggcattcctttctgttgattctaggcatttttgtttgtttttgttttgagacagagtctagatctgttgcccaggctggagagcaatggtgcgttctcggctcactgtaacctctgccacccggattcaaggaattttcctgtctc[136 bp omitted]cagcctcccaaagtgctgggattataggcatgagccactgcacccagctgatcctacgtttttagaaaaacccaaccaattgtcagccagaaaatttttaaatctacctataagctggaagctcctgctgcgagttgtcctgcctttctggaccaaaccaatgtatttcttaaaagtatgtgactgagtctccataaaatctataaaaccaagctgcaccccaacctccttgggcaactcaggacctcctgaggctgtgtcatgggtcatggtcactcctatttggctcagaataaatctcttcaaatgttttccagagtttcacttttttcatcaggagacttcaggaacagagcagtttctgtttttagtaattttatgggaaaaagttgaatctagtctagtctatatatagataacaagaactgtgctgggcgcagtggctcatgtccattaaaccaccactttgggaggctgagacgggcagatcacgaggtcaagagatggagaccatcttggccaacacggtgaaacaccgtctctactaaaaatacaaaaattagctgggtgtggtggcgtgtgcctgtagtcccagctactcggacagctgaggcaggagaatcacttgaacacaggaggtggaggttgcagtgagccgagatcccgccaccacactccctcctggtgacagagcgagactctgtctcaaaaacaacaataacaacaacaaacacacacacacacacacacaataaataaataagaaaaaagcacaagaactcgaagcaatgcagaaagctacaatctaataactggtctgttagagcttttctttagcaacacataatttttctctatacattgatcacttaggaatctcagatttaaaaaccttttaaggatagaaagtgaaaccaaggctgactttagatttcacctacattcttaaggttcctgggcctgccagaaagtgaccatttttatttacccactgtaaagctaaacacacttgaagtcaagtgttccatgcattttgatgaaagccttggtaatataaccatttttttttctttttgagacagggtcttactctgtcacctaggttggtatgcagtggtgagatctcagctcactgcagcccccacctcctgggttcaagaattctcctgcctcagcctcctgagtagctaggattacacatgtgcgccaccacgccctgctactttttttttttaaatttttagtagagatgtggtttcaccatgttggccaggctggtctcaaactcctgaccacaggtgatccacccgcctcagcctcccaaagtgctaggattacaggtgcgagccaccgtgcccggccctataaacaatgttttaaattgtatccgtctgtaaagagagagcagatttttttgtgtgtgtttaaaaaaaaagtgtgtcaggtgcaatggctcacacctaaaatcccagagctttggggggccacttgagcccagaagttcaagatcaacctgggcaacataactagcccccatttctaaaaaagaaagaaagaaagaaggaaggaaggaaggaaggaaggaaggaaggaaggaaaaaagaaaagaaagaaagggaaagaaagaaagaaaaaagaaaagaaagaaggaaagaaggaaagaaagaaaggaaagaagaaagaaagagagaaaggaaagaagaaagaaagaaagaaagaaagaaaagaaaaaagcaagcaagcgagaaagaaagaaaggaaagagaagaaagagaagtgaaagaagtatggttttataactacctgcaggtagggcctgcacgagaaggtgggtgtagttgagagaagaaaagaggaaaggagaggagagggagaggaggggaggggacaggagaggaggggagggggagggggagaagggagaggggagggggtgaagggggaggggtggaagagcaccggggacggaatggttttattactacctgcagatagggcctgcgtgaggtggtgggtgtgctgggctcaggggacctgtgggctgtgaggagatggtgatggcggggctggaaggaaacagggtggcttggcaaccaggcccaagggatcctcacatctgcttcttggaatgggcagcctttgaaaaagagtcatggtaagccacagtcacaccatccatcagatgcagaaattcttggaaatctagctgcccatcactggtgaggtccagtttcttcatcatgtggtcaaggacactggggccttctggttcttcgtgaaggcatccagttctctattcatgaagcttgggaactccgtcttggagtgaatgctattgtaaccatcctttccagtctatttctggaaaacagcaatcagggactctctgtagggctggagatttttgccatgttggagttgaatgaggcaccaagagcaggtttttactggacctgtgtaaataaccatattggcataagaatatttccaaatagtttcaaattctggaggaatcgagtagaaagaaaaagcaaacatttccatcttagttaacaaaagtatacttcacaaaattgttataaactatagacagtttaacagagaaaattttctctttgttttcatttttttgagaaaggattgtgccccgtcacccaggctggagtgcagtggtgcaaacacggctccctgcaacctctgcctcccaactcaagtgttcctcccacctcagccttgcaagtagctgggaccacaggcgcgtgccaccatgcccagctaatgtttttgtttttgtagagacagggtttttgccatgttgcccaatctggtcttgaactcctgggctcaagtgatcttcctgccttggcttccaaagtgagcaaccacatcccaccagaaaattttcttaaaggtggaaaacaaaacatttaggtaaaaaacaaatgaagtttgtattttcttaatttctttcagaaaccaggtctcctatatttttcaggttggtcttgaactcctgcactcaagggatcctcctgttctggcctccaaaagtgctgggatcagaggtgtgagccactgcacccagtccaagaataaataaagttttaaataaagttcataaaaacattattggttatttagcctcatataattgatgtttgttctgcttgatcttgataatcagttgcatgaacccatcaattttcattagagttttcaaaaataatttatttagttcattgatctgaaagttattacaaatctatattcaacagtacttgttaaaatattttttatgaatctgattctggatgcctttagagaagaatcagtactgtagatgataaagcttagaatagtaacgattaaaatctgacgaaagttcaataattgacaagaaaattcagttatttctattatagagagcattttaagataacaaccagaatcatgactaatagcatcacaccaggaccatcagacctctgtaaattttacatgatcttctgaacattaaagtccataacatatctatataaatgtaaatagtgattagtattttttattatttgacattgcttttcatataatctaacatatcaaataagcctaatgagagacacattctttaaggctctccaggggcctcactggtaaatctcaaagtcaattttaggttaaaaagacttaaattagaatttgattagtttgttcaacagcaatggataaattaaaaaagaattgcattttggggaagtttgtcaaagatgttaaaaggctcaaaacacttgtgcaaaacaggatcacgggtcactgtgaaataatagtcactcatttagcaggagtcatagtcaacagacttcaaaagcaatacagaaagttacatggacttaaaaacttaccctttcaaagctcagttttcctaagcaatcataaacataattagtaggccaggcatgttggctcatgcctggaatcccagcactttgggaggccgaggcagacagattacttgaggccaggagttcaagaccaggctgagcgacatggcaaaaccccttttctactgaaaggacaaaatattagctgggcgtggtggcccacgcctgtggtcccaactactggaggcaaaagaattgcttgaacccaggagacaaaggttgcagtgagccaagatctcgcccattgcactccagcctgggctacagagagagactctgtctcaaaacaaaaccataggatcaacagaaaggaatgttgggttaagataaaggattgtggaaacccaagttattacttgcagaggaagccttcaggtactagccttcagagataataggttgtaacatgtttgttattagactgaaagtctgtgttgatgttgatgccagagaggtataataaggcatgtctgacccatgcttcctgtcatggcctgaaaccgtctctcaggttaaattttaaaagtgccctggctgaggaagaagtccattcagatggttgcggggtggcgggggttaggattttatttttgatttacaagtcctataggacaaaagtgcatacatcttaaggaacaagtcttgtgcttgatgtatggaccacacaaaaagttcaccaaactgtccaatgccataaccagagacatttgaacgaaaaatcaagatgagaagttgacgtttccacgctatagacagcttttcccaagatgtcagaataagtcttcatatcataatgagactcttacccccttaatgtctatatttttcacttgacagaacctgacccacaaattctttccttcacctagtggtcccttttatagagttggcactctgctttaattcaacccagtcctaaaatgctactcagactacaagaggtctcatttcccccatagttttttatttgtttagctggtgtttaccttagtcttgggatcttggtt[139 bp omitted]caacatggtgaaaccccgtctctactgaaaagacaaaaataagccagtcatgctggtgggcacctgtaatcccagctactcaagaaggtgaggcaggagaatcgcttgaacccgggagatggagtgagccaggatcatgctgctgcacttcggcctgggcaacagagcaaaagtccattgcaataaaataaaataaaacaattgctgctcattttggtattatgatctttgagctctgttcttgttgcctgtgtaatatttgttcagccagttctcccaacaggatgttagcccagtgcgtccagatgattgctaatgtagatggaactaacaagatggaacttgatgctgaactccagacaaacatgcctgatttttttttccttctggcctctttgtggctcaaatgttgcccatgtctctgatatagactcccttacctttctcttgacatgggacaaagacagccggcacaggtccatcctggcatggagtgacaatgaagcctcactttaagatggctgatcagtgaggttttcaaagaaagatcttcatcaaaagagggaatgtgaaagctgattgtgcaaacgaaccagcttctccagtgccaatgagcctcatttcaaaacaatacgtaacatttttatttctaataaaacttccaacttctctttgttcgttggacatactgaagaccaccccagtccgtgtgtatgccctgaactgcaattttgtggttcccaaatagagcatttgatttagggatttgtctctataactcattttgactttgacacaattaaccagtatgatgtgttgaaaggtcaactcgccccccaacaaggtgagtattatactgaatttaaaaattcattctaggcagggctcaagtctgtaatcctaataattgctttgctttgctttgcatcttactatggacttgttggatatctaggtggctgtaaactatgcagagaaaaatagaaacagcagtggagataatcagaaaattgtagtgttcctataaaacaataacaaaagggggaaattgtaagggtaactaaacataaaattgaatttttcccattgccaaaagggaaaaaggaaaaagagccctttccccttttcatcatgcctggctcatcgttgtatttttggtagagacagggtttccccatgct[132 bp omitted]actttggattatatgaaacactacacttcaaagtgtgggatctggcttcccagagagctgtgaaaggggcagatgatgcaatctagaagtgtgggggtgttcgtgcctgtggggtaaattttgaccaataagaaaaggaaccaggagtgagagtcaggaacgtaattccctctcctctcctctccccatgcaccattccaggaggcattgtttctcagtatagtctgtctaaaggtgtcctgtatggcccaaagcctgtttccttgggaacctgagctaaagcaatgggcattcaaacacccgaagacagtgttaagtgttgtggaggacccagatctgggcagaggaaaattatcccaataagaaaatggacaatttgaggatttggaatagagggaaggactagaagaactaatagtagtatagctgaggggtaatatttttggagaaaaaggcagttctggtgattgttgcagtgaactgctcagctctgtaaaatatatacttcctttctttccatcagtctcccctatgaaatcgtccataaaatatccttttataactatctattgcctgtgaagtgaattttcttttttcctttttctttttttatttagagatagaatctctgtcgcccaggctggagtgcagtggggcgatctcgactcactgcaatctccgcctcccgagttcaagtgatcctcccgcctcagctgccctagtagctgggaatacaggtgcacaccaccaatgcccagctaattttttatttgtatttttagtagagaaggtggttcaccatcttggtcagactggtctcaaactcctgacctcacgtgatccacctgcctccgtctcccaaagtgctgggattataggtgtgagccaccacacccagcctgtcacttttcttttggagaataaaacaaattgagtcttgtgccaaaatgcaggggaagatgcacccagacaggtaacaaaatattatatacggtaatagataggttttctacatatcaataataaccatttagaaaatcaaattgagaaaaaagacacgtctatagtgacaaaagtacataaatatctaaaaccagatgattggagcaagatggcagatagatcccatgccccactcaacattccattgaactgggatgaaaatgttttcaagggtcaattcttaacagtagaggaaaataggaaagcgtgtcagtggtccaccaggaatactgaggcatacctgggagacagagtagatgggatcagactgatagagaaacccaaggagacaagaccacagctcaaatcactataggcgagagatgctgtctgagacagagacttactctgtcgcccaggctggagtgcagtggcatgatctcggctcactgcaccctccgtctcccaggttcaagggattctcccgcctcactccctgcagtaactggaattcacaggccagccaccactaccggctaatttttgtatttttagtagagacgggggtttcaccctgttggccaggctggtctcaaactcttgatctcaagtgatctgcctgcctcggcctcccgaagtgctgatattacagtgtgggtcaccgcgaccgcccaggagacgctctttgtaacaaagcctctgaaaatctccaaaccctgaatcaaagaaaacacggagctggaaagggccttaggaaaatcatcatgtaagttaatttaaaagttcatcagaaacgtctgaatcagccagattcccctccaacaccacagacagattggctggcagtagccacttttgcctctaagatgaaactctgataattattcattaaagaaactgaaggcctggcgaggtggctcacacttgtcatcccagcactttgggaggctgaggcaggaagattgcctgaggccaggggatccagaacaccctgggcaacatagtggatgccgtctctacaaaaaaatacaaaaaccagctgagtgtggtggtgtgtgcctgtagtcccagctagatcggaagctgaagtgggtgaatcccttgagcctgggagatcgaggctgcagtgagcagcctcgatcactgcatcactgcactccagcctgggcgacagactgcgatactgtctcaaaaaaaaaaaacacgaaaaagaaatgtatcaggacttggtgtaacttcagcccttcacagtaataatgaagtagagaaacacatttgtggagaggggaccatgttcactctttatccatgatagacagatagtcgggagctttatatacccaaggaacctaaggaaaaatgttccctgtcatgactcacaatcttccagccacccttccttgcacctgtcttgtgggctgggggacccaacttatggatcccatcatcccagggagaaagaaaagtcaaatccttcagtatctcttttagggtattctctcctctttgcatggaggataaggcactcaatatctagtatcggaatgttacatttgtgtaatacagaactatattgggataaaatagaatttgtttcttctgagacacaggtagaggcacgtccacactgacctgggtggaagccatctcttcctgaagtgccaggcagggcatgctcacagatctggggaacctctgttgctcctggagccccacaacctccttcctggcaccctctccctctggtggctgtgacagcccacacttggccttgggtatcccctgcttctttgcctgcccctcttctgcccaccctgcatatctctgtctcccactgtccctgctgtgaccatgaccgcctctccctccccgcactctctctctcctagggctccttgtcttgggaaaatgaacccacagcctctaccttgcaactggggacagaacccggagtttgttcaattctccctccctccaccacacacacctgtcctccttaatgtttctgaagtcagtgagctccaaactcagctcctcctgcacctgccagctgtaggacctgtgacaagacacctaccatctgtctgggactctatctctcatctatcatataggcataatgatcatagtgttctccttccaaggctggggagaaccaggaggccaaggtgatggggtatgaatggtcaaaacagctccaatcctgcctccacctggggctgctgtttcaagtccgttgtgtttcaagcattaatgtctccattcacacacaatggtttgttctaaaacagactcccctctgcccttcccttccccacaactgtttcacctctgcaccgtgcagtggtacctgtgagaaagaactgtcccattcccaaatcatcgtctccaccccagcccccaggcccttgggtggtgagacccttgatgggcagtctcatgcttctgtccaggggactttcccaccgttgctcccccgcatggagactaagtgaactcttctattccctggccatcacagggtctacagtgcacgcatcttccccatccctctgcattccccagatgatgatttcatctgtgtctcctaccacatactcccaaatggaccgtcccagccctagaacccgaaaatcgttcagagagcaaaggccaagattcccaaccacctgctgcagaatactgctccaggactgaagtgtatagtctctatcaaaataaaaactggaggccagttgcggtggctcatgcctgtaatcccaacattttaggaggccaagatgggaggatcgctttggcccaggagttcgagaccagcctgggtaatatagggagactttcttgacaaaacctgaaaaaattagtgggtcatgatggtgtgtgcctgtagtcacagcttcgctggaggctgaggtgggagaatcgcttgagcccaggagatcaaggctgcattgagctatgatcatgccactgcactccagcttggacagagtaagaccctgtctctagaaaaaagcaaaaaaaacccaacaactggaaacatcctcctctagaatggtggtcaggaacatctgtctgccctgttccctgatgtctcttcagcacctataacagcgctcagcacgaggacgcactcattagggttttgttgaataaatgactcctttgacacagcaattccacttctaagaatctttcctaaagaaatattcacacaagtgcacagagctgtgtgcacaataatgagaggagcaaacaactggggaacgtttgcaaaggtttattaactggcagtgactgatagaggggaatcggatgaggggagtacatgctgaacaggaaacagagtgaggggggcttgaccaggacacatggggaaaagcagttgggagatgcctatactggtacttggtgtgtgtgtgtgtgtgtgtgtgtgtgtgtgtgtgtgtgcgcgcgcgcgcgcatgtgtgtctgtgtggcatgtgtgtgtgtttgtgtaaatgcagaggaaaaaatctgaaattaaacactcagaactgccctcagtggtcacatctgggaagagaggagggtagtgttgttctatgcagagaatacctgacgatacttgttttctgaggtaggtgcatggatacacaaactgaaatatgcattaagtatgtcttgctcatcagtgaaaacgctaatatctaacagaatggcacactgtaacaaaatacaacagaaacactaacatcgaactcttggcacactaagaaaaatgacgctcaacttttcactgttgtgaacacttgctttcacttgctatacacctgatgacgagggatccgcagccatgcccatgttcgtgaaaggtcaccacgttctgcttctcatcatgggcatgtgtcatatccccgaggctgaggcaagaagcgagaaggaaagtaagtggcagtgagttcccaccacatgacaactcaatctcaactcctcctgacctgcagaccctgcccactccgattctgccctacctcaggacctgtacacgccttccatggttccttgaagtgaaccatctgctcataccacagtgacttcctcgcctgggttatcaattcctaggctagaggaaggtgtggcccgcatatcagtgctgacctggggtttgggaacccacagcatcctgggtagggaggatccctggatatagagggcagggagtagaaagagcatggttaggcaggcgcagaggctcacgcctgtagtcacaacactttgggaggcggaggcagatggatcacgaggtcaggagattgagaccattctggctgacatggcgaaaccctgtctctactaaaaatacaagaaaaaaaattacccggtcgtggtggcgggtgcttgtagccccagctactggggaggctgaggcaggagaatggcgtgaacacgggaggcggagcttgcagtgagccgagatcatgccactgcactccagcctgggggaacaaaaggagactcccccacccacaaaaaaaaacatgggaaatttcatcattcagcctcaatgctgtaccctagaaaattatgagaagggaatgatttggggaacaactgataagatgggataccagtaccataacagaatagcacatctgcaaggatgtgggagatgagccaaaggttcacttacggagttactcgtcatcttcctgagggtcgctgatctcttcataaatcaccagttgctttctctcacgcactctgtgggtccaggcatgtttcccccttttgggtcctatgatggagaagagttggaagatgagggttgggtagattggagagggttgggttgattggagagtgttaggctctgttttctccaaaaaaggagatgcctccccaccaccaagtgcccatgggtcttctttatccagtttttcacattctctggcttagagaggctgagaccttagacccacaccaatacaggccaaatgcaaattaaagttttagcttctggctccttccgttgtcaggtttagattcccaacctcttcacttacgggaacattcacccttacctcctttcattcagcacgtatttattaaggccacacaggcgtaccttgttttattgcacctcattttcatactgcttcacagatgttgcaattttttttttggaaattctcaccaattttacacttttccattattattatatctgttatggtgatttgtgatcagtgagctttgatattattactgcaattgtttttattgttttttagtcttttaaaataatttctgttttttatttttgtgggtacacagtaggtgtatatacttatgggatacatgagacgttttgatacaggcatgcaaatgcgtaaaaatcacatcatggaaaataagggatctatcccctcaaacatttatccttggttacaatcaatccatttacactcttttagttttcatactgcacaattaagttattattgactataatcaccctgttgtatgtaattattctgggggtaacaggaactgcactcatagaagttgacaaacttaatcgacaaatattgtgtgtgttctgactgctccaccgatgagctcttccctgcctctcttccttttcttgggcatctgtatttcctgagacatatcaacaccgaaattaggaagattaacaaccctacaatggccgctaagtgttgaaatgaaaggaagagtcgcatgtctctcactttaaatcagaagctagaaatggctaagcttagtgaggaagcatgctgaaagccaagacaggctgaaagctaagcctcttgcaccaaacagccaagctgtgaatgcaaaggaaaagttcttgaaggaagtaatagtatataatgcaaaggaaaagttcttgaagaaaataataatactaatactccagtgaacacaagaataagaaagcaaaactgccttactgcttaaatgagaaagtggtcaggatagaagacgaaaccagccacaacattcccttaagccaaagtctaattcagggcaagacccaaactctcttcaagtccatgaattctgagagaggtgaagaagctgcaggagaaacgtgtgaagctagcagaggttggttcatgaggtttaaggaaagaagccgtctccataacataaaagtgcaaggtgaagcagcaaaccctgatggagaagctgcagcaagttatccggaagatctagctaagatcactgatgaaggtggctacactaaacaacagattttcaatgtagataaaatagccttctattggaaggagatgccatctaggactttcatagctagagagcattgacttcaactttgaaagaagttctactgtgggtaaaatgctatccaaaagcatcacatactacagagaaagcattcatgaacggaagagctaatcgatgtggcaaatttcattgttgtcttcttttatgaaactgccacagccactccacccttcagcaaccaccaccttgatcagccagcagccatcaacacccaggcaggatcctccaccagcaaaaagagtgtgactcactgaagtcgcagaagattattagcattttatacaatgaattattttaaaattaagatatatacattttgagacacaatgctagtgcaaacttagtagacttcagtatattgtaaacataatgtttttatgcactgccaaaccaagaaaaaaatgtgtgtgactcactttatcgcagtggtctggaactgaacatgcaatatctctgaagtacacctatatcgggtaacaggcattgagctgagtaagatatgatcccaggtaatcacagatggaattgcttcagcacctttcatgtcatcaggccttctagacttaatttaatgcctccaaacaatttatgaactgagattctttatttccaacttataaactaggaaactggagctaagaaaatttggaagacttgccccaagtcacgtggtttttttatatgaatgacaactccagtctgtgtctctggaagtcatgtgtaacatctcatctggagctgggcgagctcctcagcccagcctggacccaggcttgtctggggtccatgccacacacccagtccacacacctgaacttagcgagaaaagccagagtggttgttcccaaattcttttctcttaccagatgtcttgttaaccttctcagaggtatttagttttcctgaggggcgcagctgtttcccattgttctgtgggccagatgcttctggcactcccttcgaatcatttccttcctctgctggcttctcgggcgtgatctttataatgtgaaggtcacagataaacagtatcagtgacatttctttagtgctttagagcttacaaagaatcttcacatgcattaccttaatcaatgttctcaacaatgctaggagagttacacttgcctaaattaggagaaacctgggaggggaggttagatgggaaaggaatggcctaactgaatatggtttccagggatagaattcttcttatcttcacactgttttaagactgacattcttgcaaacagcaaatatctccatgtaattgagagtttggtatacagaagatttggagcatagcattctaagaattcacaaggtctacaaagggaagagtttccgtaaaatacaagggatcccatataagctcgtagacagctgctgggagagtaaatgtaaagacatacagaggggacaaaacactgctgaacaagatggtgtggggagatgtatacagggaagggagagggaaagaaatggtttgctgaaattaatccaggcagcaaagaaagcagtaccagatctggcataccagcctaccgaggcaccaacattgaatgtggaattcagtgaggtggtacccataacaattctggttgcattgggatgtatcactgaccaacactcttaagctacttttttttttttttggatggagtctcgttcttttgccaggctggagtgcagtggcaggatctcggctcactgcaacatccaactcccatgtttaagcgattctccttccttagcctccagagtatctgggactacaggcaggcactaccacgccccgctaagttttgtatttttagtagagacgaggtttcaccatggtgggcaggatgatctcgatcgcttgacctcatgatctgcccgcctcagcctcccaaagtgctgggattacagtcgtgagccaccacgcccagtccttaggctactttttattcagcttcctcacttatgaaatagtgaacaatacatgtaaaataggctaagggaaggcctctctgagcttgtaaacactgtttaaatgtagtaataataacaattaatacctttcatgatccttctttgaattcggtctccacactggcaacccaactcccagatccctttaccctctaaaccagagttgaatctgcacttgtagggtcactaattcaggggcctccgagggatcccctgggctgggactgggacttcccggatgccccaggtgcagacaaggccctcaaggagctcacagtagggaggggccaacagtcaaagcgattcctaagccatgcaagtggccccagtaacagatcagagaccagatggtccttcctgttgtgagagtgggtctctcaatggaagcaccaggaggccctacgggggtgaagccctagtgagcaacatctgaacttcataacaaatgcaaatgtgaatgagctttaaatggcttggagctctggattagactaccactgccactgcgcctcaggaaaattctttaacatctctatacccggatagcctcattttattattatgctgctgataactatgatctaaaacatgaactatgattctttacttccatttcatgaaccaggaatccggagctcagaggacttagaagatttgtgccaagtcgcctgccttttatatgggtgacaactgaagtgtgtgactcattattatttggagataatagaaacaatgtcttcttaaggattaaataaattcatccatgtgaactgcttaaaatagtatttggcatcactatgaaaacaaaagaagtattaaggatcacaactgttagtattagcaagccgtcggtgctacatcaggtgttgtgatagacatagggagaagaaggcagtgagggcattgttgatattctcccactcttacagggttcacattcgtgaagggacaaaggttctctggtcctttagatttgagagacactcaccttcgggaagattccctggagcctgccgaaagtcatctgaggatgttcaactgaaagagaatacatcagaatttttctttgttggtaaagatttccaaactctagagagacttcagttgcatgagggcattctgcagcagaggttatgagtccactgattgttgaggagttatttgagatttgcttctgaattatgtttagtcatggttggtgcatttatctgtggcatcaattcagaattttccatctcatggtttatcacatggggactaaaccccatcacagtctcatctttttccattacatatcttttacttattctcaaataattaaattgattggttgggaatctgaactgtatccactcaagatgtacaacaactgaaaatcattttacacttcaaatgggtgaatcttatggtatgtgaattaagctgttaaatgtgtgatgaaccatggatgatttagtccagtggctctgaaatattttcagtacaaagacagtcctttaacgtcaaaaacttggcagatactcaagcactggcttttcagatctcttatagtgattgtgggagattgtagagtctggcctgtttagttggcgagtaataggtctattggagacagtttggactttctgaccttgtcttataattgtgttgtcagagcagaagagcaagtaaacacatatgtcccctttatatccctgaaatgtacaaagatctctaccgaagaacctgtctttttttcaccccatgttatctctcctcactgacaagtgggaaagctctctgtgtgttggatgagggatcactctttcaaactcactcccgagctcatcacagagaatcagggttctttgggaattagaggactatttggttttgataaaatacagggaaacagcagtgcttattacataatgtgttcatcaccttcactcctaagatagttattcaaacccacatgctgttaatgaaacaaactctggaagtttttggcggatctacagttgtaacattttcttttttttttttcacttgtaacattttcttaactgtcctttgattcattaacagtgcttaggaagaacaacatgtcgtttaaaaaagaaatatttcaaacacacagaaaagtatggggaataatattgagtccagtcggatctcaacattaccccacagctattttagatctgatttatttattcagaatattagaaatactacaaacaggctgggcgtggtaactcacagttgtaatcccagcactttgggaggctgcggcgggtggatcacctgaggtcaggaagtttgagaccagcctggccaacatggtgaaaccccatctctaccaaaaattaaaaaattagctgggcgtttgggtgggcgcctgtaaccccagctactctggaggctgagacaggagaatcacttgaacccaggaggtgaaagttggagtgagctgagattgccttactgcactccaccctggccgagaagagtgaaactccatctcaaaaacaaaaacacacaaaacacactatcaacaagtcacagctgaagctgtctgtgccgcactcagcaatccctgcccgccctccctccctcctccacttacagccagtcaccttaatttgatggctttttattcacattcatgtttgtatacatttaccacttacttattatctataaaaatacatattcttgttttgcatgttttaaaattttatatgaatggcctctgtagttaactttctgcatgcaattttttttttttcactcagccctgatgtgtatgagggaacaaatgcctgaggatctttcccaggtagctgagctgaaaagcagttgcgcttgaggagaccctttccagccccttcccatctactcaccctgattcccacggttagggtcattatcaaaatcattcccctggaagtctgcgacccgtttattacgcatgaaaggtgggagggtggccttgaaacctagaaagaagcaaaatgtttattccttaagagacaagcttaggcctggtatggtggctcatgtctgtagtagcagctctttgggaggctgaagctggaggattgcttgaggccaggagtttgaggctgcagtgagctatgattgcactactgcactctagcctaggtgacagactgagactctaagtcaaaaaaaaaaaagaaagagacaagccgagagaaggaaggtagggacgatgggggggtgccagatgccacagagacagttgggctcatcagaacagactcctaagggagagaaacgtgcaggatccaggtatgagctccactgtggccagtccctgccctcagccctgacaagatacagaagagcagagcacccagaagctgccttgccatttttccctgcacaaaaggaaaacgtggggtactttctgcagcctaagaaatagccaaagctggaaaagggatgctcatgtatccccagactgtctgtacctagaactttctgttacctagtttagtcatggcctcatactttctcttcatatacacatagatgattttctccgaggctttcatcttttcccactctttctcagagaagtatttggcaatatcatcgaaggcctagaaaaaaaaaaaggatttctgatagtgactcagctaggcatgtctgccattcagctggagccgcttcctgtgtgctggatctgggaagtagggatgataatccgtcctggttgatgccatggctaactgacagaacatggggcacctaccctagcttctcccctgccacacagtagagctttaatgctgctggctggctctcttcccaccttccagaacggactgagattcaccaaatgtattccacggtcacagacttgtctccagggatgctaggtgatgacagagcgagagtgagaggctcccaaggttccagatgtccccggagaccctggtccttgtccccagtacctctgtcctcccctcctcagaaaactgatcaccccacactgtcccctgggccactactatgccccctgcaggtcacctcaccttttgcatcttctctggtatttgagaaccaaccctaggtctccgtacaaaggcatcgtctccgttcatggcaccgggagcactctgtcctacaagagaaacagtctgagtctttccagctgcaggacctttggtcccatggagggagaaatcagtgaagtctggccacactcagtcacctggaatcaggagttgcatttctccatccgtggcttatctgtccctgagtaaggccatggggagaagtcagatgaaaacagggagccaggggtctctgggagaagtattgattggggatgacatgtttcctatgggcaaagcagccttgagtctttggagggggttggctaatgttgttagtagtttccctgaggccaggcttaccctgaaagatgtacagacccttgttgggaaggcagagatgtgactgtgtaattttattcagtgggggcgttctgacaccctcactcaatgaataaaggaagggaagtgagtcccagagataacatggtctctctggtgatggatctgatcaggcagagggatgggggttctgttctgttgaagagaaatgagcatcgctactatgaacggatttagaagctattactgggtgatttgtaaattattagaaggaagagagctagaatttctgagactacaagagcccgggaacacttagagagaatgtggggtgtttcaacatgcacaatcagccaggctcggtggctcactcctgtaatcccagcacattgggaggccaaggcgtgcagatcgcttgagcccaggaggtcaagaccaggctgggaaaaatagcaaaactctcgtgtctacaaaaaatacaaaaagttagctgggggtggtgtagcaggcctgtaccatcccagcactttgggaggccaaggtgggcggatcacttgagcccaggagcttgagaccagcctggtcaacatagcgaaacaatttctactaaaacaaaacaaaataaaaacaccttagcccttagcagaagtgggatggtgtgcacctgtagtcccaaggcctaggcaacaggatcacttgagcccaggaggaaagatttgagtgagtttttttttttttttttggtcagacaaggtcttgctctgttgcccaggctggggtgcactggcgtgatcatggtcactgcaacctccgcctcataggttcaagtgatccaccagctgtggcctccaaaactgctgggattacaagtgtgagccaccgcgccccgcccaaatttcttaagttactgcagagttcccaggaaaaatcccatacttgaaaaagttagaaactgacaggaaagatttgagatggcgacctgcctcatatacactccttattaaaactagataacaaatgcaccacggaggaggggaggggtaggaagaatggaaaaagaaaatcagcaaatgcttactctgattttggaagaatcgaaacaatcagagcgtgcgtactctgtggaaaaatcgagagagagagaaagtcagagcatgcgtactctgaacttaaagtagccaatcccagggtatgctttaggcgggaaaattagagtctccacccccactttgagaaggtgctgtccctggaggttggactgacagacgccacatcagcttcgcttgttccgcctactgttctgacttctgattggccagatggagttcactaactgctctgattggtccatctccttgggcagtgacattgcacaatattgtctcctcctccagccacactttgttgccactgcaacacccaaaaagtgggtggtcctcaggcgccgtcaggagatgttgaactctctgaagactgtccctggatcttgggttaaacatctgtattctagtctgaacagcgagaagaaaaaaatagttgatctgtgatttttccacttgaaagacacaatgttttccaaactagcacatttgcagagctttgctgtacttagtcgtggctttcattcttcagtggcttctatatctgttgcaactgaataaacagtccaaggccctccaacctctgattacagttttgaaagggaatctaagtgtggtgtgcacaattaccatcctttacctgtagccctggagagacgaaaatgtatttacttatgggatgtgattgtggtattggttacatccaccttagccaatccttccgcctcagtctcgggactacaggcaggaaccaccccacccccactcatattttttgttttttgattttttaatagagacggttttgctgtattggccaggctggtctcatcatcctgggctcaagcgatcctcccgccgcagccctgggactacaggcatgcaccaccctgccgacgcttttttaaatttttttttatttttattttttagtggaaaccaggttttgttatgttggccaggccggcgtcaagctgctgggctgaagggatcctcccacctcggcctcgggactacaggcatgcaccaccctgcccacactattttttttcctttttttttttttagtaggaaccaggtgtcgatatgttgcccaggctggcttcaatctcctggactcaagtgatgctttcacctcggcctcaggactacaggcatgtgcctttctgcccggctcatttttattttatttatttatttatttttatttttgtttatttatttttttaggagagacaggctttcgctatgttggccaggctggtatcgacctcctgggctcaaacaatcctcccaccttggcctcggaactacaggggtgagccactctgcccgtgctatttttttgttgttctgtgttgttagtagaaatgggttttcgctatgttggccaggctggcttcgaccacctgggctcaaacaatcctcccgcctcggcctcgggactacaggatcacaccacccagcccccactaatatttttaatttttctagtagaaacagttctgctatgttgtccaggttggtctctacctcctgggctcaagcgattctcctgccttggccttgggactacaggcatgcaccaccctgccttttgctatgttttccaggctggtcttgacatcctgggctcgctcaattatttgaacctgggaagcagaggttgcattgagctgagatcacaccactgcactccagcttgggcgacagagcaagactgtcaaatagataaatacatccatacatgaaagaaagaagaaagaaaagaaagaaagaaaaagaaagaaggaaggaaggaaggaaggaaagaaagaaagaaagaaagaaagaaagaaagaaagaaagaaagaaagaaagaaagaaagaaagaaaccagctgaatctccgtaaaaacagtaagctttgtggtatattaacttaccctcatcccatctcgtgctcccagcttggttctgttcattgctgatgaaatacacataggattggccagaactggtagatggctggctgttgatcatgaaaatgtcagacctgatatagtcctccttggaaaggccctttctgggggctgacactctgtgtcggtggcgctgtgggacgatgacataatgctgaccattaagccaggcgaccatgggtccacatacggtggcaatccactaggctgctgagtggccatcgcagcccttgaggttttagaagaaaatcttgctgaaaatacagaacaaaatgggtattctcttgagaaatgaacccatgaagctaccttctgatgctgtaactgctgtaagaggaagagaattattgtgtgtatgtgtgtatgtatgtatgtatttagagtcagaggttcactctggttgcccaggatgcaatggtgcgatcttggctcactgcaacctctgcctgctgggttctagcgattctcctgcctcagcctcctgagtagctgggattacaggcacgtgccactatgcccagctaattttcatatttttagtagagactgggtttcaccatgttggctacgctggtcttgaactcctgacctcaggtgatgcacccacctcggcctcccaaaatgttgggattacagacgtgagccactgtgcccgggaggaaaataattattaaatgctattgttattaaagaaaccaaagattgtgatgtttggaaggtgtgtctacgacttcgagattattgaacatggccgggtacagcagttcacacttgtaatcccagcactttgggagggcgaggtggacagatcacttgaggtcaggagtccattgttgctattgctgttgctgagacagagtctcactctgtcgcccaggctagagtgcagtgtctcggcttacagcaacctccgtctcccgggttcaagcgattttccagcctcagcctcccgagtagctgtgactacacgtgcgcaccgctacgcccaggtaatttttgtattagtagtagagatggggtttcaacatattggcaaggctggtcttgaactcctgacgtcatgatccgcccacctcaacctcccaaagtgctgggataacaggatgagccactgtgcctggccaatagttcatttttattactgagtagtattccatggtatggatgtaccacagtttgaccattcacttattgtaggatatattgattatttccagctattgactattacaagtaaagctgctatgaacaattatgtacaagtttctggatgggcatacattttaatttctctgaagtgtaattgttgaattgtatggtcattgcatgtttagttttataagaaactaccaaactgctttccagagtggctgtaagattttaccttcccagcagcacttaatgaggtgtccattttctctgcatccttgtcaccatttggtgttgtcactatgtcttttattttagctattgtaataagtgtgtagtgatacctcatcgtggtgttattctgcatctagtgaagcaaatgagggctgaacatcttttcatgtgcttatttgcttatttcctcttcagtgaaatgtatgctcatatcttttcatgattttctaattggattatttgtttgtattttttaccattgaggtttcttttattattattatttttcttgagacagagtctctctctgttacccaggctggagtgcagtggcacgatcttggctcactccaacctccgcctcccaggttctagcaattctcgtgtctcagcctcccgagtagctgggattacagggtcgcaacatcgtgcctgtctaatttttgtagtttagtagaaatgggtttttgctatgtttcccaggctggtctcgaactcctgacctcaagggatctgccctccgtccaccttgacctttcaaagtgctgggattacaagtgtgagccaccatgctcagccaaccattgagttttgagagtagtatatatatccattatatattctggatgtgagtcctttcttggatatgtggtttgcaaacattttctcccaggtcataccctgttttttcatccttttaacaagatttcttgcagagcaaaagttttaaattggatgaaatctaatttatttttttccttatggattatgctttttgaaccattgactatgccctagatctcagacgtttctcttatattttcttgtaaaagttttcttttagttttatattttagatttaaatctatgatcgacttcagttacttttttgtataaaggtttgaagattagggcttttttttttttttggcctgtggctctgcaactgctccagcaccatttgttaagcagactatccttccttctttttgtctcttggtaaaaaatcagtgtggggctatttctaggttctctattttgttccagtgatctatgtgtctattcttctcccagtactacacagtcttgattcctgtagccatataagaagtattgaaatatggtagagccattcctcccaccttattcttctttttcaaaaattgtcttagctatataaatattttttgagatggagtcttacttgtgtcacccaagctggagctcagtggggtgatctcggctcactgcaacctctgcctcccaggttcaagtgattctcctgcctcagcttcccgagtagctgggatttcaggcacgcaccgccacacctggctaattttgctatttttagtagggacgggattttgccatgttggc[132 bp omitted]aatgaatatacatagaaacagatcagtgaaacaaaatagaaagtcaagaaacagactaatttatataccaacttcagcatgcatttccaaacagtgggcaaaagatggggtgtataataaaggattgtataataaaggattgttgtctatccatttggaaaaataaacattaaatccttactttcaaccacataaaataataaattctaaaaattcagagacttaaatatgaaaaagtgaagtcataaagaactagatgacaatttaggaaaatattacagtgtaagacatcttgagttggcataggcacttcctgacattacaccaaggctataaacaattaatctgacataggatgtaaaaattaaagtatcatgtaagtcaaaagacaccataaacaactatttaaaaaggcaaattttaggccaggcgcgggggctcacgcctgtaatcccagcactttagggggctaaggagggcagatcacaaagtcaggagatcaacaccatcctggctaccaccgcgaaaccctgtctctactaaaaatacaaaaaattagccgggcatgctggcacacacctgtagtctcagctacttggaaagctgaagtaggagaattgcttgaacacaggaggcagaggttgtaaatttaagaggaaggaggtgatttcaataagcaatggtgaggagaaaaatagtacaatttattgaaaagtataaagtttagattgtaaatttaaaaaattatagtcttgaactaaaattgcagatgggaggagggacaggaaagaaaagagaagttcttttgttgttcaaggaatggatacagattctaatgaatgatagaatggtagaatgattaaaaacactagcatttcattttgttttattttagagacggcctcactctgttgcccaggctagagttccatagcacaatcgtggctcactgtagccccagcctcctcagctcaagtgatcctcctgcctcagcctcccatgtagctgggactacaggcgtgcaccaccacccctggttaattaaatttttttattttttagtagagacagggtcttgctatgttgcccaggctgatcttgaactattgtcctcaagcaatcctcccacttctgcttctcaaagtggtgggattacagccatgacccactgtgcccagttaacactagcattttatagtacaaactctggagccagacagcttgggttcagtttctggcttctcaactttttaagctgtgtgaccttgtgtaagtcatataacctttctgtgtctcaggctactcaaaagtaaactggggataaccacactagctcatttgattgctgtgattaaatgggcaaatacatgtaaagcacttagaatagtgcctgtcatgtggttaagtggtatatatcttttagctgtttatatatatatatatagatatagtttagtttagttgttagtaatgacttcaaattacttttaaaatgtaaaggcataaaggcatatctggttccagaagaagatggtgaaccagcaatagctgctggcttccttcccaaacccaaccctgcagatgccacagaagaggtgggaagtggttggagttcagaacagttcctgtaacaaaacccttgatggtttagccccactgggggaaaaggtcagaggccacagatggaggatcagcccaggtggagctttctaagttgcattcttgttttctccttgttttctggaagccttattacctgttgtgtaaacatatagagcagacacttggcagggctggcctagtgctagcccaaagtggcctgataacattaaggaatagggggcttggaaagctcctagaaaaagtgcagtctcatcaaagctggccagtaactgagcattccttttctacctctccctctgccctctgagctaggcaattacaaccaatatcacccacccgtagactccctccacgctgtaaggcagaaatcccgtaagcgtctctgggggctcataggctagggactggaaagaagaattggctcagctcagctctagaggctccgtatcctacaacctatcaatccagaaaccttgaaactcgtgtggggtgtttgggctgacacacc[132 bp omitted]gccaacatggcgaaaccccatctctactaaaaatacaaaatgagtcgggtgtggtggtgtgcacaggtagccccagctactcgggagactgaggcaggagaatcgcttgaacccaagaggtggaggttgcagtgagctgagattatgccactgcactccagcctgagtaacaaagcaagactctgtctcaaaaaaaaaaaaaaaaaattccttgctttcagcactttggagttattacaccattgtatccttgcctccagtgtggtgtttgagagatctgatgtcagttcaattatttttcctctgtaagtaacctgctatttctctctgatcattttaaaaatattttttctttctttcacaattttacatttcactgttcctgtgtgtgtgtactataatacctttaaatcttaagtcattttttttaatctgagaaattctctttcattatttatttggggtacactctcctttttaatgactatattctcttcttataaggctactattagatgtgttttgacatttattctatccttcctattaattaacttttctttcatttactttatctctatccattaccgattacttttatgaattctttagacacattttctcagttcagtaattgctttttcaactatatccgttttaatatccaacctattccactgaattatttatttgagcatttaatgttttcatatccaatctatccaataggttatttatttatttatttatgatggagtcttgctctgtcacccaggctggagtgcagtggcgcgatcttggctcactgcacctcgcctcctgagtccaagcaattctcctgcctcagtagagaattaaaaaaaaaaatagctgcatttcgtggtgcgtacctgtagtcccagccactcgggaggctggggcaggaggattgctttggccctggagtttgaggctgcagtgagctaggattgggtcactgcactctagcctaagtgacagagtgagacaaagtctctgtctctgaaaaataagaaaaaagattgtagggacgattttactcagagtggggagtactatgatatgtacacgggccactgcaacggggttttgggttaggagagtgatatcgggatcaacttcaactccaccaagggcaagtggggatttatagtcaaggagtagggtcagggggtcagaagatgggaaattacttggaggagacatcaggtgcaggcagattctggctaaacagacttgacaggaattttgctgaaacaggctaaatgggcagagtccctggatggagaggcatgagccacctcatccggccaactagctttgtttaatatgtcagttttcataagtaatctaggtataattgttaaaaatgaataaaagaggtaaatgtgagatacatgtttataaatgaacttttcatgtaatttgaaatcttttttctcttgctcttatcataggaagatgaaatattaaagttatgttatgttagatttagtaataggtactcgttaaatgtcgggatcacttccatctaagaaaataactgatacaaatcgctaaacataaatacaagtttgttcttggcccttaagttttataaaagagaaaagatatttggatctgttaataaaatgccctgttctacattgaaaatgtagaaaattgttctggccgggggaggtggctcacgcctgtaatcctagcactttgggaggctgaggtgggtggatcacgaggtcaagagatcaagaccatcctggccaacatgatgaacccccgtctctactaaaaatacaaaaattagctgggtgtggtggtgggcacctgtagtcccaactacttgggaggctgaggcaggagaatcgcttgaacccaggagcagaagtttctgtgagcctagattgagccactgcactcctgcctggtgacagagcgagactccgtctcaaaaaaaaaaaaaaaaaaaaaaaaaaaaaaaaaatttttaaagattataaaatatatattcatgatatgttaatatataacaattccaaactactttctagatttttactaaaaattaaggttatggccgggcgtggtggctcatgcctgtaatctcagcactttgggaggctgaggcaggtggatcacgaggtcaggagttcgtgagccaacatggcgaaaccccgtctctactaaaagtaaaaaagttagccagatgtgttggcccatgcctgtaatcccagctactcaggagcctgaggcaggagaatcactggaacccgggaggtggaggttgcagtgagctgagattgcgacactgccctccaacctgggtgacagagcaagactctgtctcaaaaaaaaaaaaaaaagaaaaatagtctatggccataccacctgaatgcaccaaatattgcatgatctcagaagttaaacagggtcagacttggttggtacttggattgcagtccaatataaaaatgaaaaattgtaggactaagactgggggtaaaaaaatgatggaatgtctacgcaagttgctgagggtttatgaaggatgagccttgggaagggagtcttatatatcatctggttggttgggattgaaaagaaattgtttatcagtttttctaaaaattgaacattagtatcaagggtgcactgaagcagggtgagtctgctcctctaggtttgaaacaggttttcttaacatgttgatctgtttttctttatcttttaaataatcagtctaaaaaaacagggattttgttttaagatagtttcttaactgcatttattaggtttttgtttttgttttgttttctgagatggagtctcgctctgtcacccaggctggagtgcagtggtgtgatccagccactgtagtaagcaaggttgctcactgcaacctccatctcccaggttcaagtgattctactgcttcagcctcccgagtagcttggattacaggtgcccaccaccacggccggctaatttttgtctttttagtagagatggggtttcaccatgttggccaggctggtctccaactcccgacctcaagtgatctgcctgccttggcatcccaaagtgctgagattacaggtgtaagcccccacacccagctataattagcaataatataataaatttagtttgtacaatggttttgaatgaagatcccaagcctaggggccaccagctaaacaaatcagaagactacggggcaattgagtgagacctcttatagtctttgagtagtattttgggactgggttgaattaaagcagagtgccgactctataaaagggaccactaggtgaaggaaaagatttggggtcaggttctgtcaagtgaaaaatgtagacattcagggggtaagattctcattatgatatgaagacttattctggcatcttgagaaaagctgtctacagtgtggaaacatcaacttctcatcctgacttgtcgagcaaatgtctctggttatggcattggacagtttggtgaactttttatgtggtccatacatcaggcatgagacttgttctttaaaatttgtgcagtttcaccttgtaggacttgtaaatcaaaaataaaatcctaagccccctgcccccaaccatctgaaaagacttcctcctaagccagggctcttttaaaatttaacctgagagacggtttcaggccatgacaggaagtgggggtcagacatgcctcattatacttctctggc[132 bp omitted]gctaacatagtgaaatccggtatctactaaaaatacaaaaaattagccgggcgtggtggcacatgcctgtagtctcagctactcaggaggctcaggcaagagaatcgctcgaacccgagagccagaggctgcagtgagcagagaaggagccactgcactctagcctggcgatatagtgagactctgtctcaaaaagaaaaaaaaaaatgttacaacctattctctctgaagcatagtacctgaaggcttcctctgcaaataagaactcaaaaaaaactaagagcgactcacttcacgtaatcaactttcacaatggttaaagcagagtcctgcttagcaatgcacaaaaattctcctttgtgacccattcattttactgctgttgactttcttgcttatcctttcagacagagacactcttctttgaccaaacttgagtggggctcctctgagtcctgtttctgactaggccccaacctcgggctctgtccttcatccagggactctgcccatttagcctgtttcagcaaaaatcctgtcaagtcagtttagccagaatccccctgcacctgaggtttcctccaagtaatttcccatcttctgaccccccgaccctactccttgactacaaatccccacttgtccttggtggagatgaagtcgatcccaatatcactctcccactgcaagaccccattgcagtggtccctgtgcctatcacaggagtcccccctctgagtaaaatcatccttacgatctttttgttattttcagagacaaagtctcactctgtcactcaggctggagtgcagtgacccaatcctagctcactgcagcctcaaactccagggcccaagcaatcttcctgccccagcctcctgagtagctgggactacagatacgcactaccaaatccagctattttttttttaattctgtatgaacccaggaacttgatatgcccatctaattcttgtggttttttttgtttttgtttttgtttttgtttttgtttttgttttttgtagagatggggtttcaccatgttgcccaggctggtcttgaattcctgggctcaaccaatcctcttgcctcaggctcccaaagtgctgggattacaggcatgagccactgcagctggcccttccttacagtctttaataagtgcaataaatacttgtttgctttaacatttccctgtgtcttcaatctcctcaagtgttatatgcctgacattgccatactccaccaaaaatataaaaattcctttctttcacgggcgcagtggcttacccctataatcccagcatattgggaggccaaggcggacagataacctcaggtcaggagttggagatcagcctggccaacatggcgaaaccccatctctactaattttgtactaaaagtacaaaaattagctgggtgtgatagtgtgcacctgtagccccagctactcaggaggctgaggaggagaatcacttgaaactgggaggtagaggttgcagtgagctgagatcatgccactgcactccagcctgggtgacaaagcgagactctgtctccaaaaaaagaaaaaaaaattcctttcgttcaacactttggagttattacaccattgtatccttgcctccagtgtggtgtttgagagatctgatgaaggctgaaatatttttcctttgtaagtaacctgctattttcctctgatcatttaaaaaaaatttttgtctttcataatttttcatttcactgttcctgtgtgtgtatgtgtgtgtgtacgatgatccctttaaatcttaagatattcctctaaatctgagaaattctcactcattacttgtttaagtacactctcctttttaatgactatgttctcttcttataaggctactattagatgtgttttgacatttattcttctatgctccctattaattaacttttctttcgtttacttcatctctatccattaccgattacttttatgaattctttagactaatttcctcaggtcagtaattgctttttcaactatatccgtcttaatatccaatctatcccaatgaattatgtatttgagcagttaatgtcttcatatccaatctatccaataggttttatttttatttatttatttgagacagagtcttgctctttcgcctaggctggagtgcagtgactcgatcttggctcactgcacctctgcctcctcctgagtccaagcaattttcctgcctcagtcccttgagtagctgggaccacaggcatgtgacactatgcctgactaatttttgtatttttgtagagacggggcttcaccatgttggccaggctggtctcgaactcctgaccacaggcgagccgtctgcctcagtctgtcaaagtgctgggattacaggcatgagccaccgcgcctggcctatctctggaacttctattggatgaacgttgaaacttctgggatctattctccatttcctttattattttcctttcatattttctatttcatgatccttttctgctatacggtgaagtagtgccatgcctgaacacattttttcattgggttgttccagtttctcttattgatatgcaaaagcttcgttgtatattagagatggttgctgttaatttattgtggatgcttcaccaatttccccaacatttgcctttttaaacagttgtttatggtgtcttttgaattagatgatactttaatttttacatctttaaatttgtcagattcattgctcatagccttggtgtaatgtcaggaaatgcctatgccaactcaagatgtcttacactgtaatattttcctaaattgtcatctagttctttatgacttcacgttttcacatttaagtcactgattttttagaatttgttattttatgtggtttaaatggatagacacttgtcaagcaatcatttattatgcaacccatcatcttttgcccactgtttggaaatgcatgctgatgttttcatatagattagtctgtttcttgacttctattttgtttcactaataaatgtttctatgcgtattcattttttattgctgctgtaacaaattttgaatagcttagacactgctaggcgcggtggctcacgcctgtaattccagcactttgggaggccgagacaagtggatcgctcaaggagttcaagaccagcctggccaacaaggtgaaaccccatctctactaggggttggtgatgggcgcctgaaatcgcagctatttgggagttcagaacagttcccactaacattattccctcatacacaccagggctgagtgaaaaaacaaattgcacacaaaaagttaactacagaggccattcatataaaatgctaaaacatgcaaaacaagagtatatatttttatggataataagtaaatggtaaagtataaaaacatgaatgagaataaaaaaccatcaaattgagaagaatggctgtaagtggagaaggagggagggcagggattgcacagaaagcttcaaggtgacttgttgatagtggttttctttgtttgtttgtttgtttgtttgtttgtttgtttgtttttgatggagtttcgctcttgtcgcccaggctggagtgcaatagcataatatcagctcactgcaaccttcaactcccgggttcaaatcattctgctgcccacgcctcccgagtagctggaattacaggcgcccgacccacacccagctattttttttatttttggtagcaacaaggtttcaccatgtttgccaggcaggtctcaaacttcctcatctcagatgatccacctgcctcagcctcccaaagtgctcagattacaggcatgagctaccacacccagcgcgtttatagtatttctaatactctgaataaataaatcagatctaacatagctgtggggtaatgttgagatccgactggactcaatagtattccacatacttttccacgtgtttgaaatatttcatttttaaaggacatgttgttcttgctaagcactgttaatgaatcaaaggacagttaagaaaatgttacaagtgaaaatataaaaaaagaaaatattaaaagcaaagatctgcaaaaaaaatccagagtttctataattaacagcatgtaagtattggataagtatcttatgagagaggataatgaacacattatgtaataaagatggatgtttctctgtattttatcaaaaccaaatagtcttctcattcccaaataaccccaattctccgtgatgagcttggaagggattttgaaagagtgatccctgatccaaaacacagagagctttcccacttgtcagtgagcagagataacatagagtgaaaaaaagacaagttcttgcgaagagatttttgggcatttcaggactattaatgggacatatgtatttacttgctcttctgctctgacaacacaattataagacaaggtcagaaagtccaaactgtctccaatagacctattactcgccaactaaacaggccagattctacaatctcccacaatcactataagggacctgaaaagccagtgcttgagtatctgccaagtttttgacgttaaaggactgtttttatactgaaaatatttcagagccactggaccaaatcatccatggttcatcacacatttaacagcttaattcacataccataagattcacccatttgaagtgtacaatgattttcagttgttgcacatcttgagtggatacagttcagattcccaaccaatcaatttaattatttgggaaaaagtaaaagatatgtaatggaataagatgagactgtgatggggtttagtccccatgtgataaaccatgagatggaaaattctgaattgaagccacagataaatgaaccaaccatgactaaacataatttagaagcaaatctcaaataactcctcaacaatcagtggactcataacctctgctgcagaatgccctcatgcaacagaagtctctctagagtttggaaatcttcaccaacaaagaaaaattctgatgtattctctttcagttgaacatcctcagatgactttcggcaggctccatagaatcttcccgaaggtgagtgtctctcaaatctaaaggaccagagaacctttgtccctccacggatatgaacactggtaagagtggaagaatatcaaaaataccctcactgcctcctccccatgtctatcacaacacctgatgtagcatcaatggcttgataatgctaacagttgtgatccttaatatttcttttgttttcatagagatgccatatattctaaacagtttacatggattaatttatttaatccttaagaatacctctacgacgacgtttctattactatctccaaataataatgagtcacacacttcagttatcatccatataaaagccatgtgagttggcgcaaatcttctaagttctctgagatccagacttctggtcaatgaaatggcagtaaagaataatagttcatgttatagatcatagttatcagtaaaataataatgaaatgaggctctccttgtacagagatgttaaagaattttcctgaggcgcagtggcagtggtagtctaatccagagctccaagccatttgaagctcattcacgtttgcatttgtttatgaagttcagatgttgctcactaaggctttaccccatagggcctgctggtgcttccattgagacacccactctcacaacaggaaggaccagctggcctctgctctgttaccagggccactcgcatggcttaggaatcggtttgactcttcacggtccctccctactgtgagctccttgagggccttgtctacaagtggggcatccgggaagcccccgtcccagcccaggggatccctcggattcccctgaatgagtgatcccaaaagtgcagattcaactctggtttagagggtaaagggatcttggagttgggttgccattgtggagaccaaattcaaagaaggatcatgaaaagtattgttttttattattactacatttaaacagtgtttgcaagctcagagaggacattcctttagcccattttacatgtatttttcactatttcataagtgaaaaagctgtataaatgtagtttaacaatgttggtcagtgacacatcccaatgcaaccagaattggtatgggtaccacctcactgaattccacattcaatgttggtgcctcggtaggctggtatgccagatctggtactgctttctttgctgcctagattaatttcagcaaaccatttctttccctctcccttccctgtattcatctctccacaccatctttcccagcagtgttttgtcccctctctatgtttttatatttactctccgagcagctgtctacaagcttatatgggatcccttgtattttatagaagctcttccttttgtagaccttgtgaattcttagaatgctatgctccaaatcttctgtataccaaactctcaattacatggagatttttgctgtttgcaagaatgtcagtcttaaaacagtttgaagataaacattctaaccctggaaaccccagtcatttaggccattcctttcccttctaacctcccaggtttctcctaatttaggcctgtgtaacaatcccagcattgttgagaacattgattaaggtaatgcatgtgaagattctttgtaagctctaaagcactgtagaaatgtcactgatacagtttatctgtcatcttcacattatacagatcatgcctgagaagccagcagaggaaggaaatgattcaaaggaagtgctagaagcatctggcccacagaacgatgggaaacagctgtgccccccgggaaaagcaagtagctctgagaagattcacgagagatctggtaagaggaaacgatttgggaacaacccctctggcttccctggctatgttcaggtgtgtggactgggtgtgtggcatggatcccagacaagcctgggtccagactggcctgaggagctcacccagcttcagatgagatgttaggcatgactaccagagacacacatttgagttgtcatccatataaatgtgctcaagcaattctatctgtgataacctgggatcatatcatactcagctcaatgcctgatacccaatacaggtgtacttcagagatattgcaggttcagttccagaccactacaataaagtgagtcacacacattgtgtttcgtttgtttcgcagtgcataaaaacattatgtttacactatgctataatctactaagtttgcaatagcattatgtctaaaaatgtacataccctaattttaaaataattcattgtataaaaatgctaacaatcttcggagccttcagtgagtcacactccttttgctggtggaggatcttgcctcggtgttgatggctgctggctgatctaggtggtggttcctgaagggtggagtggctgtggcagtttcttaaaagaacacaacaatgaaatttgccaaatcagttagctcttcctttcatgaaagatttctctgtagtatgtgatgctatcggatagcattttatccatagtagagtttctttcaaagttggagtcaatcctctcttgctatgaaagtcctagatggcatcttcttcaatatagaaggctattttatccgtattgaaaatctgttctttagtgtagccaccttcatcagtgaccttagctagatcttctggataacttgctgcagcttctccatcagggtttgctgcttcaccttgaacttttatgttatggagacagcttctttccttaaacctcatgaaccaacctctgctagcttcacacgtttctcctgcagcttcttcacctctctcagctttcatggacttgaagagagttcgggtcttgctctgaattagactttggcttaagtcaatgttgtggctggtttcatcttctgtccagaccactcaaactttctctatttgagcagtaagtctgttttgctttcttatttgtgtgttcactggaatattagtattattatttccttcaagaacttttcctttgcattatatactattatttccttcaagaacttttcctttgcattcacagcttggctggtgcaagaggccgagctttcagcctgtcttggctttcagcatgcttcctcactaagcttaggcatttctagcttctgatttaaagtgagagacatgcgactcttcctttcatttgaacacttagcggccattgtagagttgttcattgtcctaatttcagtgttgctgtgtctcaggaaatagggaggcccaagaaaaggaggagagatggggaagagctcatcgatggagcagtcagaacacacacaacattgatcgattaagtttgtcatcttctgtgggtgcagttcctgttacccccaaaataattacccacaacagggtgattacagtcaataataacttaactgtacattttaaaaaactaaaagagtgtaaatggattatttgtaatgcaaggataaatggttgaggggatggataccctattttccatgatgtgattattacacattgcatgcatgtatcaaaacatctcatgtaccccataagtagatacacctattgtgtatacaaacaaaaaacagaaagtattttaaaagactaaaaaacaactacaataataacatcgaaactcactgatcacagatcactataagagatataatcgttaatgggtgcagcacaccaacatggcacatgcctccatatgtaacaaacctgcacgttgtgcacatgtaccctaaaacttaaaatataataataataaaattaaaaacaaataaatatatttgaacctaattatatacattcagaacttcatacaaatttggactggagttatatacaaatttattaaaatagtaaaattaaaaataataataataatgggttaaggtctcagcctctctaagccagagaatgtgaaaaactggataaagaaggcccatgggcacttgggatggggaggcatctcctttttttaagaaaacagagcctaacactctccaacctacccaactcttatcttccaactcttctccatcataggaaccaaaagagggaaacatgcctggatccacagactgcgtgagagaaagcaactggtgatttatgaagagatcagcgaccctgaggaagacgacaagtaactccataagtgaacattcggctcaccctccacatccctgcagatgtgctagctattctgttatggtactggtatccaatcttgtcacttattccccaaatcattcccttctcataattttctagggtacagcattgaggttgaatgacgagattttccatgctctttctactccctgccctatatatccagggatcctccctaccccggatgctgtgggttcccaaaccccaggtcagcactgatatgcgggccacaccttcctctagcctaggaatagataacccaggcaaggaagtcactgtggcatgagcagatggttcacttcgaggaaccgtggaagccatgtgcaggtcctggggtaggacagaatcagagtgtgcagggtctgcaggacaggaggagttgagattgagttgtcacgtggtgggaactcactgccacttatttccttctctcttcttgcctcagcctcggggatatgacacatgcccatgatgagaagcagaatgtggtgacctttcacgaacatgggcatggctgcggacccctcatcatcaggtgcatagcaagtgaaagcaagtgttcacaacagtgaaaagttgagcgtcatttttcttagtgtgccaagagttcgatgttagcatttccgctgtattttcttgcagtgtgccattctgctagctattagtgttttcattgatgagcaagacgtaatgcatatttcggtctgtgtatccatgcacctatctcagaaaagaagtattgtcaggtattctctccatagaacagcactaccctcctctctccccagatgtgactactgaggggaggtctgagtgtttaatttcagattttttcctctgcatttacacaccacacacacacacacacacacaccaagtaccagtataaggatctcccatctgcttttctccattgccatgcatcctggtcaagcccccctcactctgtttcctgttcagcatgtactcccctcatccgattcccctctatcagtcactgccagttaataaacctttgcaaacgttccccagttgtttgctcctctcattgttgtgcacacagctctgagcatgtgtgtgaatacttctttaggaaagattcttagaagtggaattgctgtgtcaaaggagtcatttattcaacaaaaccctaatgagtgtgtcctcgtgctgagcgctgttctaggtgctggagagaccttggggaacaaggcagacagatgttcctgaccaccattctagaggaggatgtctccagttgtttgtttgtttgtttctagagacagggtcttgctctgtccaggctgaagtgcagggggatgatcatagctcaatgcaaccttgaactcctgggatcaagtgatcctcccaccttggcctcctaaagtgctgtgattacaggcatgagccactgcacctggcctccagtttttattttgatagagacgatacacttcagtcctggagcaggattctgcagcaggtggttgggaatcttggccttctctctctgaacgatttttgcattctagggctgggacagtccatttgggagtatgtgggaggagacacagatgaaatcgtcatctggggaacgtggaggaatgaggaatatgcatgcactgtagaccctgtgatggccagggaatagaagagtccacttagtctccctgcaaaggagcaacggtgggaaagtccccttgacagaagcatgagactgcccatcaagagtctcaccacccaagggcctgggggctggggtggggacgatgatttgggaatgggacagttcttcctgacatgtaccattgcatggtgcagaggtgaaacagttgtggggaaggaagagcagaggggagtccattttagaacaaaccagtgtgtgtgaatgaagacattaaagctccattcacacacaacagacttgaaacaccagccccaggtggaggcaggattggagctgttttgaccattcataccccatcaccttggcctcctggttctccccagccttggaaggaggacactatcatcattatgcctatatgatagatgagagacagagtccagacagatggtaggcatcttgtcacaggtcctacagctggcaggtgcaggaggagctgagtttggatctcactgacttcagaaacattaaggaggacaggtgtgtgtggtggagggaggaggaattgaacaagccccgggctctgtccccaatcacaatgtaaaggctgtgggttcctttacccaagacaaggagccctaggagagagagagagcagggagggagaggcaatcgtggtcatagtggggacagtgggagacagagatatgcagcgtgggcagaagagaggcaggcaaagaagcaggggatacccaaggccacgtgtgggctgtcacagccaccagagggagagggtgccaggaaggaagttgtggggctccaggagcaacagaggttccccagatctgtgagcatgccctacctggcacttcaggaagaggtggcttccacccaggtcagtgtggatgtacctctacctgtgtctcagaggaaacaaattctattttatcccaatgtagttctatatgacacaaatgtagcattcagctactagatatcgagtgccttatcctccatgtaaatacagcagaggataccctaaaagagatactgaaggttttgatttttctttctccctgggaagatgggatccataagttgggtcccccagcccacaagacaggtgccaggaagggtagctggaagattgtgagttatgacagggaacatttttccttaggttccatgggtatataaagctccagactatctgtctgtcatggatagatgaagagtgaacatggtcccctctccacaaatgtgtttctctccttcattactactgtaaagggctgaagttacaccaagttttgatacattactttttgggagcaagccccccaaaatctggccataaactggccccaaaactggccatatagaaaatctctgcatcactgtaacatgttcataatggccctaacgcccaagctggaaggttgtggatttactggaatgagagcaaggaacacctggcctgcccaggacggaaaaacgcttaaaggcgttcttaagccacaaacaatagcatgagtgatctgtgccttaaggacatgctcctgctgcagttaactagccaaatctattcctttcattcggcccatcccttcatttcccataagtgatatttttagttaatcgtatatctatagaaacaatgctaatgagtgctttgctgttaataaataggtgggtaaatctctgttccaggctctcagctcttaaagctgtaagatccctgatttcccacttcacacctctatatttctgtgtgtgtgtctttaattcctctagcgctgctgggttagttatggtctccccaaccgagctgttctcggcaattaattttttgggtttttgtgagacaagatagtgctctgttgcccaggccggaatgcagtggtgcaattacagctcactgcagcctggatctccaaagctcaagggattctcccacttctgcttcctaactagctgggattacaggcacaggccaccacacccagctaatttttgtattttttgtggagatgggatcccactatgttgcccaggcttgtctcgatctcctggcctcagcaatcctcctgcctcagcctcccaaagtgctgggatgacaagtgtgagccacctcgccaggccttcactttctttaatgaacaattatcagagtttcatcttagaggcaaaagtggctactgccagccaatctgagtgtggtgttggagtggaatctcgctgattcagatgtttctaatgaacttttaaatacctgatgattatcctaaggccctttccagctccgtgttttattgattcagagtttggagtttttcagaggctttgttacaaagagcatctcctgactgggcgcagtgacccatgttgtaatcccagcactttgggaggccaaggcaggcagatcacttgaggtcaggagttcgagaacagcctggcctacatggcaaaacccccgtctctactaaaaatataaaaattagccggccgtagtggcgggcgcctgtgaatcccagttactgtgaggactgaggcaagagaatcacttgaacctgggagacagaccctgcagtgagctgagatcaagccactgcactccagcctgagcaacagagtaagtctctgtctcaaaaagcaaacagcatctctttattacagtgatttgagctgtggtcttgtctccttgggtttctctatcagtctgatcccaactactctatctcccaggaatgcctcaatatttctggtggacacgttttcctatttccctctactgttaagaattgacggccaggcgcagtggctcatatctgtaattcctgcactttgggaggctgaggtgggcggatcacaaggtcaggagatcgagatcatcctggctaacacagtgaaaccctgtctctactaaaaaatacaaaaaaaaattagccgggtgtggtggcgggcacctgtaatcctagctactgaggaggctgaggcaggacaatggcatgaacccaggaggcggagct[135 bp omitted]cccctctccctctccccacggtctccctctccctctctttccatggtctccctctgatgccgagccgaagctggactgtactgctgccatctcggctcactgcaacctccctgcctgattctcctgcctcagcctgccgagtgcctgtgattgcaggctcgcgccgccacgcctgactggttttcgtatttttttggtggagacggggtttcgctgtgttggccgggctggtctccagctcctagcctcaagtgatccgccagcctcggcctcccgaggtgccgggattgcagatggagtctcgttcactcagtgctcaatgttgcccaggctggagtgcagtggcgtgatctcggctcgctacaacctccacctcccagccgcctgccttggccccccaaagtgccgagattccagcctctgcccggccgccaccccatctgggaagtggggagcgtctctgcctggccgctcatcgtctgggatgtgaggagcccctctgcctggctgcccagtctggaaagtgaggagcgtctctgcccggcctccatcccatctaggaagtgaggagcgcctctgcccggccacccatcgtctgagatgtggggagcgcctctgccccgccgccccgtctgggatgtgaggagaccctctgcctggcaactgccccgtctgagaagtgaggagcccctccgcctggcagccaccctgtctgagaagtgaggagcccctccgcccggcagccaccccatctgggaagtgaggagcgtctccgcccggcagccgccccgtccgggagggaggtgggggggtcagccccccgcccggccagccgccccgtccgggaggtgtggggcacctctgcccggccgcccctactgggaagtgaggagcccctctgcccggccaccaccccgtctgggaggtgtacccagcagctcattgagaacgggccatgatgacaatggcggttttgtggaatagaaagggggggaaggtggggaaaagattgagaaatcagatggttgccgtgtctgtgtagaaggaagtagacatgggagacttttcattttgttctgtactaagaaaaattcttctgccttgggatcctgttgacctgtgaccttacccccaaccctgtgctctctgaaacatgtgctgtgtccactcagggttaaatggattaagggcggtgcaagatgtgctttgttaaacagatgcttgaaggcagcacgctcgttaagagtcatcgccactccctaatctcaagtacccagggacacaaacactgcggaaggctgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaagaaataagaaaaagaaaaaaaaaaaaaaaaaaagaattgacccttgaaaacattttctccccagttcaatggaatgttgagtggggcacgggatctatctgccatcttgctccattcatcttgttttagatattttatgtatatttgtcactatataagtgtagtttttctcaatttggttttgtaattggttattacaggtatgtagaaaacctatctatgattgtatataatatttgtctacggccataccaccctgaacatgcccgatctcgtctgattgtatataatattttgttacctgtttgggtgcagcttcccctgcattttggcacaagactcaatctgttttattctgcaaaagaaaactgacagcagtggcttatgcctgtaatcccagcactttggtaggccaaggcgggtggatccccttaggacaggagttcaagaccagcctggccaagatggtgaaaccccatctgtactaaaaatacaaaaaaaaaattagccaggcgttggtggtgcatgcctgtattctcagctactagggcagctgaggtgggaggatcacttgaactcgggaggtggagattgaagcgagccgagatcgccccagtgcactccagcccgggagacagggattctatctctaaataaaaaaagaaaaagaaaaaaagaaaattcacttcacaggcaatagacagttataaaaggatactttgtggatgatttcataggggagactgatggaaataaaggaagtatatattttacagagctgagcagttcactgcaaaaatcaacagagctgcctttttctccaaaaattttacccctaagctattctactactggttcttctagtccttccctctattccaaatcctcaaattgtccatttccttattgggataattttcctctgcccagatctgggtcctccacatgtaacactgtcttcggtgtttgaatgtccattgttttaggtcaggttcccaaggaaacagaatttgggccattccggacacctctagacagactatactgagaaaccatgcctggaatggtgcagggggagaggagaggagagggaatttacatacctggctctcactcctggttccttttcttattggtcaaaatttaccccacagtcaggcactctcctacacttctagattgcatcatctgcccctttcacagctgtctggaaagccagatcccacactttgaagtgtagtgtttcatacaatacaaaaatggtagcagagaccaggtgcagtggctcacgcctatagtcccagcactttgggaggccgaggcaggcagatcatgaagtcaggagttcgagaccatcctggccagcatggtgaaagcccatctctactaaaaatacaaaaattagccgggcatggtggtgcacacctgtaatcccagctactctgcaggctgaggtaggagaatcgcttgaccctggggggctgagtttgcagtgagctgagatcccactgctgcccttcagcccgggtgacagagcaagactctgtctcaaaaacaaacaaacaaacaaaagtggtagcagaagtcagaaagtccaggtatgtagctaattggcctgctagtacagcagcagctaagggtgaaaactgaatactcccagtcaaatcctaagttcaccgagtaattggagtacccatctgtgttaattaattgcttttatctgaaagaaaaataaaactcatttatctatgacaagcaggtgcttacagcttggagcaaggcacctaggctaaactcgcctgctgacaaggagacaaggacatcatgttcctcaaagttcacatttcaaagagatggctccaaggccctgaagaaagacattcctagggaatgggcgtggtggctcatgcctgtaatcccaacactttgggaggctgaggctggaggatcacttgaggcctggagttcaagttcaagacattcctgggttctaggatggccagaggcttacagatcaaaggaataatttacaaatacaaattttctcaagaaaatgctctaaggaaagtgaaatggggaaaggtctcttcttgcccttttggcaacaggaaaaactcaatttatgtttagttacccttaaaatttcccacttttgttattcttttatagtaacactacaattttctaattatctccactgctgtttctatctttctctgggtagtttatggccacctagatatccaacaaatccataataagatgcaaagcaaagcaattatcaggattataatagaatgtttttttttttttcaggacagagtttcactcttgttgcccaggctggagtgcaatggtgcgatgtcagctcactgcaacctccatctcctgagttcaagctattctcctgcctcagcctcccgagtagctgagattacaggcatgtgccaccacgcccagctaattttgtattttttgtggagatggggtttcaccatgtcagccaggttggtcttgaactcctcaccccaggtgatcagcccaccttggtctcccaaggtgttgggattacagacatgagccaccactcccagcctagaaagagtttttaaattcagtataatactcaccttctcggggcgggggacctttaaacacatcatactggttaaatgcatcaaagtcaaaataaattatagagacaaatccctaaatcaaatgctgtatttgggaatcacaaagttgcaattcagggcatacacacggactgcggtggtcttcagtatgtccaatgaacaaacagaagttggaagctttatcagaatgaaaaatgttacatattgttttgaaatgagactcattggcatgaggcttattggcactggagaagctggttcgttcgcacaatcagctttcacattccctcttttgatcaagatctttctttgaaaacctcactgatcagccatcttaaagtgaggcttcattgtcactgcatgccaggatggacctgtgccagttgtctttgtcccatgtcaagggaaaggtaagggagtctatatcagggacatgggccacatttgagcaaaaaagaggtcagaaggaaaaaaaaattcaggcagatttgtctggagttcagcaacaagttccattttattagtaccatctgcattagcaatcatcttgaagcactaggccaacattatcctgttgggagaactggcttaacaaatattacacagacaaaataatggagctcggagatcataatacaaaactacttagcaattgttgtattgtattgtgttgtgttgtattgtattgtgttgtattgtattgtattgtattgtattgtattgtattgtattgtattgtattgtattgtattgcattgcattgtattgtattgagatagaatcttgctctgtcacccaggctggaggtggcacaatcccggctcacagaaacctccacctcctgggtttaagcgattctcctgcctcagcctcccgagtagctgggattacaggtgccccccaccactccaggctaatttttgtgttttcagtagagacaggattttaccacgttggcactcactgcaacctttgtctcctgggttcaagcaattctcgtgtctcagccacctgagtagctgggattacaggcacccgccaccacacctggctaatttttttgttaattttcatagacaccaggtttcaccatgttggcgaggcttgtcttgaactcctgacctcaggtgatctacctgccttggcctcccaaagtgctgggattacaggtgtgagccaccagcccggctcaacctaggtttttagataaacccaaccaattgccaaccagaaaatttttaaatctacccataagctggaagcccctgcttcgagttgtcctgcctttctggaccaaaccaatgtacttcttaaatgtatttgactgagtctccataaaatctataaaaccaagctgcaccccaacctccttggggaactcaggacctcctgaggctgtgtcatgggccatggtcactcctatttggctcagattaagtctcttcaagtgttttccagagtttgactcttttcatcagcagacttcaggaacagagcagaatctgtttttagtaattttatgggaaaaagttggaactagtctattctatatgtagataacaagaactcggccgggcgcagtggctcacacctgtaattgcagtactttgggaggctgaggtgagtggaccacgaggtcaagagatcaagaccatcctggctaacatggtgaaaccccatttctactaaaaatacaaaaattagctgggcatggtggcatgcacctgtagtctcagctattcgggaggctgaggcaggagaatcacttgaacaggcgaggcgcaggttgcagtgagccaagatcgtgccactgcactccagcctggtgacagagtgagattccgtctcaaataaaaacaaacaaaacaccaagacctcgaaacaatgcacagagctacaatctaataactgatctattagaacttttctttagcaacataatttttctctatatattgatcgcttaggaatctcagatttaaaaacctcttgaggatagaaagtcaaaccaaggcagaccttagatttcacctacctttttaaggttcctggggctgacagaaagtgaccgtttttattcacccactctaaagctaaaaacacttgaagtcaggcattccatgcattttgatgaaagccttggtaatatagccaatgttttattttttttttttctttttgagacagggtcttgctctgtcacccaggctggtgtgcagtgatgagatctcagctcactgcagcctgcacctcctgggctcaaccagttctcctgcctcagcctcctgagtagctgggattacaggcgtgtgacaccatgcctggctaaatatttttgtatttttagtagatatgtgatttcaccatgttggccaggttgatctcaaactcctgacctcgggtgatccacctgcctcagcctcccacaatgctgggattataggcgcaagctactgtgccctgccctataaccaatgtttttaattgtatccctctataaaaaaaagagagcagagatttttttgtttgggtttttgtttgtttgtttgtgctgaaaaaaaaaagtgggctaggttcaatgcctcacacctgtattcccagaacttttggaggccactttagcccaggagttcaagaccaacttggccaacataatgagacaaaaaaaaaaggaaaagagaaaagaagagaagtatggttttattactacctgcaggcagggcctgcatgaggtggtaggtgtgctgggctcaggggacgtgtgggctgtaaggagatggtgatggtgaggctggaaggaaagggggtggcttggaaaccaggcccaagggatcctcagatccgcttcttggaatgggaagcctttaaaaaagagtcatggtaagccacagtcatgccatccatcagatgcagacattcttggaaatctaactgcccatcactagtgaggtccagtttcttcatcatatggtcaaagacactggggccctctggttcttcgtgaaggcatccagttctctattcatgaagcctgggaactccatcttggagtgaatgctattgtaaccatcctttccagtctatttctggaaaacagcaatcagggactctctgtagggctggagatttttgccatgttggagttgaatgaggcaccaagagcaggtttttactggacctgtgtaaataaccatattggcataagaatatttccaaatagttttcaaattctggaggaatcgagtagaaagaaaaagcaaacatttccatcttagtttacaaaagtatactttacaaaattgttataaactatagataatttaacagagaacattttctcttttttttcttcatttttttgagaaagggttgcactctgttgcacaggctgagtgcagtggtgcaaacacagctccctgcaacctctgccttttggatcaagtgttcctcccacctcggcctcccaaatagctgggaccaccatgccaccatgcccagctaatttttttgcatttttttgtagagacagggttttgccatgttgcccagactcgtcttgaactccggggctcaagcgatcttcccaccttggccttccaaagtgagccaccacaccccaccagaaaattttcttatatgtggaaaacaaaacatttaggtaaaaaacaaagtttttattttcttaattttttttaagaatccaggtctcctatgtttcccaggttggttttgaactcctgcactcaagggatcctcctgtcttggcctcccaaattgctgggattacaggtgtgagccaccgcacccagcccaagaacaaataaagttttaaataaaggtcaaaaatacattaactttatcagttatttagcctcatgtaattaatttttgttctgcttgatcttgatgatcagttgcatgaacccatcagtttctgttagagttttgaaaaaaaaattattcagttcattaatctgaaagttattagaaatctatattcaacagtacttgttagaatcttttttatgaatctgattctagctgcctttagagaagaatcagcactgcaggtgaaaaaacttagaatagtgatgattaaaatctgatgaaagttcaatatctgacaagaaagttcagctatttctattatatagagcattttaagataacaaccagaatcatgactgatagcatcacaccaggaccatcagaccactgtaaattttgtatgatcttcagatctataaacattaacatcaataacatatctacgtaagtgtaaacatataatattaacatcaatatcatatctatataaatgtaaacagcaattagtattattttattatttgacattgcttttcatataatctaacatatcaaataagcctaatgagagacacattctttgaggctctacaggggcctcactggtaaagctca[132 bp omitted]aaacccatttctactaaaaatacaaaaaaaaaattagccaggcatggtggcaggcacctgtagtcccagctactcgggaggctgaggcaggagaatggtgtgaacccggga[132 bp omitted]aattggatattggggaagtttgtcaaagagtttaaaaagctcaaaacatttgctcaaaacaggatcacgggtcactgtgaaataatagtcactcatttaggggcgcatgttctcaggacctcctgagggctgtgtcacaggccaaaaataaattctaaaaaaaaaagaaaagaaaaagggaaaaaagaaaatagtcactcatttaaccagattgatagtcaacagacttcaacagcaatacaggaagttacttaaaaacataacccttccaaagctcagttttcctaagcaatcagaaacctaattaataggctgggcatgtcagctcacatctggaatcccagcactttgtgaggccgaggcaggtggataacttgaggccaggagctcaagaccagcctgagcaacatggtaaaaccccatctctattaaaaggacaaaaaattatctgtgtgccatggcctgcacctgtggtcccagctactccgaggcaggagaattgcttgaacccgggagatggagatcacagtgagccgagatcacaccattgcactccagcctgggtgacaaagagagactctgtctcaaaacaaaaagaaaacaaaaccctaggatcaacagaaaggaatgccagggttaagaaaaaggatggtagagacccaagttgttatttccagaggaagccttcaggtactaggctacagaaagaataggttgtaacatgtttctttttttttttcttcttcacctggagtctcactttgttgcccaggccagagtgcagtggtgccacctcagctcactgcaacctctgcctcccgggttcaagtgattctcctgtctcagcctcctaagtagctggaattacaagcgcctgccaccatgcctggctaatttttgtattttcagtagggatggggtgtcaccatattggtcaggctggtctcaaactcctgacctcaggtgatccacctgcctcagactcccaaagtgctaggattacagttgtgagccaccacgcccggccataacatgtttcttatcagacttcaagtctgtgttaatgttgatgccagagaggtataatgaggcatgtctgacccccacttcctgtcatggcctgaaactgtctctaaggttaaattttaaaagagccctggctgaggaggacgttcattcagatggttgggggcagggggcttaggattttatttttgatttacaaatcctgtaaggtgaaactgcataaattttaaagaacaagtctcatgcccgatgtatggaccacacaaaaggttcaccaaactgtcccatgccataaccagagacattcgaacaacaaattaggatgagaagttcatgtttccacactgtaaacagcttttcccaagatgtcagaatgtcttcatatcataatgagactcttacccacttagtgtctacatttttcacttgacagaacctgacccccaaatgctttccttcacctagtggtcccttttatagagttggcactctgctttaattcaacccagttgcaggaagtcagggaccctgaatggagggactggctgaagccatggcagaagaacataaattgtgaagatttcttttttttttttttcatcttttttttttttttattttttttttttattttattttttttattatactctaagttttagggtacatgtgcaccatgtgcaggttagttacatatgtatacatgtgacatgctggtgtgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgagctcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaaattgtgaagatttcatggacatttattagttccccaaattaatacttttataattttttatgcctgtctttactgcaatctctgaacttaaattgtgaagatttcatggacattcatcacttccccaatcaatacttttgtgatttcctatgcctgtctttactttcatctcttaatcccatcatcttcataagctgaggatgtacgtcacctcaggaccctgtgatgattgcacattgtttaaacaatatgaaatctgggcaccttgaaaaaagaacaggataacagcgatgttcagtgaacaagggagataaccattaggtctggctacctgagagtcgggtggaacagagccatatttctcttctttcaaaagcaaataggagaaatatcgctgaattctttttctcagcaaggaacagccctgagaaagagaatgcgttcctaggggcaggtctctgaaatggctgctctgggaacatctgtcttttacagttgtagataagggatgaaataagccctggtctcccacagcactcccaggcctattaggaagaggaaattcccacctaataaattttggtcagaccggttgcctgctcttaaaccctgtctgctgataagatgttaccaacgacaatgtgtgcccgaaacttcattagcaattttaatttcaccccagtcttgtgatctcgccctgcctctatttgccttgtagtattttattaacttgtgaagcatgtgatctctgtgaaccacaccctatttgtacactccctccccttttgaaaatcactaataaaaacttgctggttttgtggcttgcaggggcatcacggaacctgctgacatgtgatgtctcccccagacacccagctttaaaatttctctcttttgtactctttccctttatttctcagactggccgacacttagggaaaatagaaaaggacccacaaagaactattgggggtgggttcccccaatacaacccagtcctaaaatgctactcaaagactacaagaggtctcattcacttcccccatagtcttttgatttgtttggctggtggcccctaggcttgggatcttggttcaaaac[133 bp omitted]caacatggtgaaaccctgtctctactaaaaagacaaaaattagcagggcgtggtggtgggtccctgtaatcccagctactggggaggctgagacaggagaatcacttgaacccgggaggtggaggttgcatcaagcaaccttgctcactgcactggctggatcacaccactgcactccagcctgggtgacagagcgagactccgtctcagaaaacaaaaacaaaaacaaaaacttaataaatacagttaagaaactttcttaaaatgcaaaatctccatttttatagactgattacttaaaaggtaaagaaaaacagatcaacatattaagaaaacctatttcaaacttagagaagcagactcgctctgcttcagtgcacccttgacactaatgttcaatttttagaaaaactgataaacaatttcttttcaatcccaacctatctgatgatatataagactccctccccaaggttcatccttcataaaccctcagcagcttgcctagacactccatcatttttttacccccagtcttagctgtataaatttttatttttatattggattccattccaagtactaaccaagcccaaccctgtttaactcctgtttaacttctgagattagacaagatttggcgcattctgggtggtatggccatagactattttttatattaaaacaaccaatcattttattttaggataaaaatgtattgtcactcagaccacacaaaattttgtcatataaaaattattttttgtacattttgtatatagaattacatatacaaagaacttttaatttttagtaaccttaatttttagtaaaaacctaggaagaagtttggaattgttatatattaacatctcatgaatatatattttataatctttaaaaatatttttatagaacaattctcattgtggaacagggcattttattaacagattcgaatactttttgtcttttataaaacgtaaggggcaagaacaaacttgtatttatgttcagcaatttgtatcccgtgttttcttagttggaaatgatcccagcatttagtgagtacctattacctaatctaacataacataactttaatatttcatcttcatatggtaagagcaagagaaaaaaatatttcaaattacatgaaaagttcacttataaacatgtatctcacatttacctcatttattcattttaacaattatacctagattacatat[131 bp omitted]tgaaccccatgtctactaaaaactacaaaaattatccaggcgtagtggcgcacgcctgtaatcccagttacttgggaggacgatgcatgagaatcagttgagcctgggaggtgaaggttgcagtgagcccaggtcacaccactgcactgcagcctgggtgacagagcgaaacactgtctcaaaaaaagaagaaaaaagacaagataaaaaagacaagacaagaaaagaaaggaaaagaaaagaaaagaggaggtttcataaccaggagagagagaaagacccttcctaacaaattcccaaataaaactgaactcaactccccagcaaatggcagtttgatccaagacagattcaccagggggaaaactggcaaccagaaaaacaaaaggctcaagggggccaagtgtgcagacctcacaccatagttccagaggtcattgatatctccaaggtgagtcagcttcggaccccatttctgacaccacaaatatcaaagtcaaagactatggagacgagtcacttttttaactacaatattaaggatgttatattatgtttgtttttgttttaagacagggtattgctctgtcgcctaccccggagtgcagtggcacaatctcgcctcactgcaacctctacctccccgactcagcctctggaatagctgggattacaggcatgcaccacatccagctaactttttgtattttttgtagagacagggtttcaccacattttccagactggtcacgaacccctgggctgaagcgatccgccggccttagcctcccaaacggctgggattacaggtgtgagccaccatgcttggccatgaatctctaaacattttatttgagaatcatagaattgtaatctgaggcatacacccaaactggctggtctttgatttgtccaaagaacaaggagaaagttgagagttttattagaaacagaaatgttacctatatttttcaaagcaagtccattggcaccagagaagctttcaggagctggaagctctgattggtgagtgcagacaataggtaaaataagccttagagtcattgcaggttgtttcagcagttactaggtaaaagtggtcttagggtggcagcaggccatttcagccaccagccttgtggaaaattcaattattggggcaggtgcaatgtgccctgagtgctttttctcctggccactcaactctgacatagttgcggatgtcgaaaatgactcaatttgggtgggttgtggtggagcacacctgtaatcccagcactttgggaggccaaagcagacagttggcttgaggtcaggagttcgagaccagcctggtcaacatggcaaaacccttactctagtaaaaatacaaaattagtcgggtgtggtggcacatggctgtagtcccacctactcgggaggctgaggcaggagaatagtttcaatccaggaagctgaggtttcagtgagctgagatcatgcactgcactccagcctaggtgacacagggaaaaaaaaaaaagaaaaaaagaatgactcaagtcacataatcagctttcacaatggttaaagcagagtcctgcttagcaatgcacaaaaattctcctttgtgacccattcattttactgctgttgactttcttgcttatgctttcagacagagtcactctcctttgaccaaacttgagtcgggctcctctgagtcctgtttctgactaggtcccaacctcgggctctgtctttcatccaggaactctgcccatttagcctgtttcagcaaaaatcctgtcaagtcagtttatccagaatccccctgcacctgagttttcctctaagtaatttcccatcttctgacccctggctcctactccctgactacaaatccccacttgtccttggtggagttgaagtcgatcccaatatcactctcccactgcaagaccccattgcggtggtccctatacctatcacagaagtccccgctctgagtaaaatcgtctttacgatctttttttttattttcagagacaaagtctcactctgtaactcaggctagagtgcagtgacccaatcctagctcactgtagcctcaaactccaaggcccaagtaatcttcctgccccagcctcccgagtagctgggactagaggtacgcaccaccaaatccagctatcttttttttaattctctgcagacccaggaacttgatatgcccgtctaatttttgtattttttgtagagacggtgtttcgccatgttgcccaggctggtcttgaattcctgggctcaaccaatcctcttgcctctgtctcccaaagtgctgggattacaggcctgagccactgcagctggcccttccttacagtctctaataagtgcaataaatacttgtttgctttaacatttccctgtgtcttcagtctcctgaagtgttatatgcctgacatttccttactccacctgatataaaaaaatcctttcttttgctgggtgcagtggcttacccttacaatcccagcacattgggaggccaaagcaggcagatcacttcaggtcaggagttccagatctgcccggccaacatggcaaaaccccatctctactagaagtacaaaaattagccgggtgtggtaccgtgtgcctgaagccccagctactcaggtggctgaggaggagaatcacttgaaactgggtggcagaagttgcagtgagccgagatcatgccattgcactccagcctgagtaacaaagcgagactctgtctcaaaaaaaaagaaaaaaaattcctttcgttcaacactttggagttattacaccattgtatccttgcctccagtgtggtgtttgagagatccgataaaggtttaaatatttttccttttcatgtaacctgctatttctctctgatcattttaaaaatattttttctttgtctttcacaatttttcatttcactgctcccgtttgtgtgtatgtgtgtgtgtatgatgatccctttaaatcttaaggcattcatctaaatctgagaaattctcattcgttacttttttacgtacactttcctttttaatgactatattctcttcttataaggctactattagatgtgttttcacatgtattctactatcctccctattaattaactttttttcatttactttatctctatccattaccaattacttttatgaattctatacgctcatttcctcagctcagtaattgctttttcaactatatctgttttaatacccaacctattccactgaattatttatttgagcagttaatgtcttcatatcctatctatccaataggttttctttttatttatttatttgagacagagtcctgctctttcgcccaggctggagtgcagtgactcgatcttggctcactgcagctctgcctcctaagtccaatcaattctactgcctc[134 bp omitted]cagcctctcaaagtgctgggattacaggtttgagccacagtgcccagccattttttttaaagccagtttcactattgttgcccagggtgaagtagaatagtgtgatctcacctcactgcaacctctgcctcccaggttcaagtgattctcctgccccagcctcctgagtagctggggttacaggcgtgcaccaccacactgggctaatttttgtatttttagtagagatggggtttcaccatgttggccaggctggtctcaaactcctcacctcgggtgatctgcctgccttggcctcccaaagtgctgggattaaaggcatgagccatggcaccaggcccattctttctattctctacctctggaacttccttttttaattaattaattaatttatttatttttttgagatggagtctcgctctgttgcccaggatggagtgcagtggtacgatctcggctcactgcaacctctgcctcccaggtcctagtgatcctcctgcctc[135 bp omitted]ggcctctcaaagtgctgggattacaggcgtgagccactgcgcctggcctatctttggaacttctattggatgaacgttgaaacttctgggatctattctccatttcctttattattttcgtttcatactttctattttgtaatccttgtctgctatacggtgaagtagtgccatgcctgaacacattttttcaatgggttgttccagtttctcttactgatatgcaaaagctttgttgtatattagagatggttactgttaacttattgcggatgcttcaccattttccccaaaatttgcctttttaaacagctgtttatggtgtcttttgacttagatgatactttaatttctacgtctttaactatgtcagattcattgttcatagccttggtgtaatgtcaggaagtgcctatgccaactcaagatgtcttacactgtaatattttcctaaattgtcatctagttctttatgacttcatgttttcacatttaagtcaccgaatttttagaatttattattttaagtggtttaaagtaaggatttaatctttattttttgaaatggatacacacttatcaagcaatcatttattatacaactcatctgttgcccactgtttggaaatgcatgctgaagtttacatatagattagtctgtttcttgactttctattttgtttcactaataaatgtttctgtgtctattcatttttgattgctgctgtaacaaattttcaatagcttagacaacactgggtgcggttgctcactcctgtaatcccagcactttcagaggctgagacaggcagatcacttgaggacaggagttgagaccagcctggccaacatgacgaaaccccatctctacttaaaatacaaaaattagccaggtgtggtggcacacagctgaaatcccagctattcaggaggctgaggcaggagaatcacttgaacccgggagaaggaggttgcagtgagccgagatcaccccaccgcactccagcctgggcaacacaagtcagactgcatctcaaaatatatatatgtagctcagacaatttttggaatataagaataaggtgggaggaatggctctaccatatttcaatacttcttatatagctacaggaatcaagactgtgtagtactgggagaaaaataaacacacagatcactggaacaaaatagagaacctagaaatagccccacactgattttttaccaagagacaaaaagaaggaaggattatctgtttaacaaatggtgctggagcagttgcagagccataggccagtaaaaacatgacctaatcttcatacctttatacaaaaaaacaactcaagtggataatagatttcaatctaaaatataaaactaagaaaaagcttttacaagaaagcataggagaaacatctgggatctagggcatagtgaacggttcaaaaagcataatcaataaggaaaacaaataaattagatttcacccaatttaaaacttgtgctctgcaagaatccctgttaaaaggatgaaaaaacaggatcttgactaggagaaaatatttgcaaaccacatatccaagaaaggactcacatccagaatatataatggatatgtatagtactctcaaaactcaatggtaggctgagcatggtggctcatgcttgtaacccaagcactttgaaaggttgaggtggacggaaggcagatcccttgaggccaggagttcaagaacagcctgggaaatgtgacaaaaacccatctctactaaaaatacaaaaattagacaggcatgatgatgcatgcccgtaatcccagctactcagggggctgaggcatgagaattgcttgaacctgggaggcggaggttggagtgagccaagatcgtgccactgcactccagcctgggtaacagagcgagactctgtctcaaaaaaaataattaaaaaaacctcaatggtaaaaaatacaaataatccaattagaaaatcatgaaaagatatgaacatacatttcactgaagagcaaataagcaaataagcacatgaaaagatgttcgacactaatttgcttcactagatgcaaattaagaccacgaagaggtatcactatacacttattacaatagctaaaataaaagacatagtgacaacaccaaatggtgacaaggatacagagaaactggacacctcattaagtgctgctgggaaggtaaaatcttaaagccactctggaaagcagtttggtagtttcttataaagctaaacatgcaattaccatacaattcaacaattacacttcagagaaatcaaaatgtatgcccatccagaaacttgtacataattgttcatagcagctttacttgtaatagccaaaagctggaaataatcaatatgtcctacaataagtgaatggtcgaactgaggtacatccataccatggaatactactcagtaataaaaatgaactattgactgggcccagtggctcatgcatgtaatcccaacactttgggaggtcaaggagggcggatcacaacgtcaggagttcgagaccagccttgccaatatgttgaaaccccatctctactactaatacaaaaattacctgggagtggtgatgcgtgcctgtagtcacagctacttgggaggctgaggtaggaaaatcacttgaacccgagaggcagaggttgcagtgagccgagatctgccaccgcactccagcctgggcgacagagcgagacgctgtcacaacaacaacaacagcaacaatgaactattgatccacaaatattaatatcttgggtaaatctccagggaattatgctgagtgaaataagcccttaaaatgttatatactataagatttcatttgtacagcattctagaaaagacaaaattgtggaaatgaaaaacagattagtggttgccaggggttagggatggtggatgggaggagagtattactaaaaatgactagcacaagggatagcattgtggtgatggaaaggttctgtaccttttttttttcccaagaggaattctcagtctgtcatctaggctggaatgcagtgacacgatctcggctcactgcaacctctgcctcccaggttcaagtgattctcctgtctcagcctcccatgtagctaggactacaggcacccaccacctcacctagctaatttttgtattttagtacagacagagtttctcctcacctcaccttttgtatcttctctggtatttgagcatcatccccagctctctttgcacagttgttgtctccgttcatggcaccgggagtagtctgacctgcaagtgaaacagattgagactttccagccgcaggacctttggtcttgtggagggagaaatcagtgaaggccggctacactcagtcacctggaatcaggtgctgcatttctccatccggggcttatctgtccctgagtaaagatatggggagaaatcagatgaaaacagggaaccagggatctctgggagaagtattgataggggataacaggtttcctatgggcaaagcagccttgagtctttgggagggggttggctactcttgttagtagtttccctggagctaggcttaccctgaaagatgtacagacccttgttggggaggcagggacatgactatgtaattgtattgagtgagggcattctgacaccctcactcaataaaaaaaggaagggaagtgagtcccagagataacatggtctctccggtgatggatctgatcaggcagagggttgggggattctgctctgttgaagagaaatgtgcatggctactgtgaacggatttagaggctattactggatgatttgtaaatcattagaaggaagtgagctagaatttctgagactacaagagtccatcaacacttagagagaatatggggcgtttcaagatgcagcaatcagccaggagcggtggttcacgcctgtaatcccagcacattggccaatcctcctgcctcaatcttgggactacagtacaggcgtgcaccacccagcccccactaatatttttatttttgtttttttagtagagacggttttgctatgttgaccaagttggtcttgacctcttgggctcaagcgatactcccgcctcagcttcgggactacaggcaggcaccaccctgccttttgctatttttcccaggctggtcttgacctcctgggctcactcaatgatttgaacccgggaagcagaggttgcattgagctgacatcacaccactgcactccagcttggtagacagagcaagattgtcaaataaatagataaataaaaagaaagaaagaaagtaagaaagaaagaaagaaagaaaagaaagaaagaaagaaagaaagaaagaaagaaagaaagaaagaaagaaagaaagagaaaggaaggaagaaagagagagaaagaccagctgactctccataagaacagtaagctttttggtattttaacttaccctcgtcccatctcatgctcccagcttggttctgttcattgctgatgaaatacacataggattggccagaactggtagagggctggctgttgatcatgaaaatgtcagtcctgatatagtcctccttggaaaggccctttctgggggctgatactctgtctgcgatgctgtgggacgatgacataatgctgaccattaagccaggggaacgtgggtccacatacggtggcaatccactaggctgctgagtgaccatcacagcccttgaggttttagaagaagaaaaccttgctgaaaatgcagaaaaaaaatgggtattatcttgagaaatgaacccatgaagctaccttctgatgttgtaactgccgtaagaggaaaatgattgttttatttattcatttagttatttttttgagtcagaggttcactctggttacccaggctggagtacaatgccacgatcttggctcactgcaacctctgcctcctgggttaaaaggattctcctgcctcagcctcctgagtagctgggattacaggcatgtgcccctatgcccagctaatttatgtatttttagtagagatggggttttgccatgttggccaagctggtattgatctcctgacctcaggtgatgctcctgcctcggcctcccaaaatattcgggttacaggcgtgagccactctgcccaggaggaaaagaattattaaatgctattgttattcaagacaacaaagattgtgatgcttggaaggtgtgtctgcgacttcgagattatggatttctggccgagccaatccatggtgacatcatcagtttttgcctctgctggtggtcaaggaggatgagattagagagcccagtgaaatcaataacaagaccatcttgttgttctgagggtagcagccgttttcagtggtccctgggagccgactagagacaggtggtcctgtaaaagctctgctcttaatgcgggcacattccactcccatgtgtcttcaaaacctttttctggaatatatttttttttcagttgatacataatagaatagtgtttatgaagctgccttttgctttgtaacataaataagagaatgtaatggcatctatattcagtgaaagtgttttgatgtgcagaacatggcgaggtgcagtggttcatgcgtgtaatcccagcattttgggagggcgaggtgggcagatcacttgaggtcaggagtttgagaccagcctggccaaaacagagaaaccccgtctctactaaaaatacaaaaattagctaggtgaggtggtgggtgcctgtagtcctagctacatgggaggctgagacaggagaatcccttgaacccgagaggcagatgttgcagtgagccgagatcgtgccactgcactcaagcctaggtcacagagtgagaatccctttggaaaacagacaaaaaaaaggtacagaacatttccatcaccacaatgctattccttgtgctactcatttttagtaatactcactctcctcccacccaccactcctaacccctggcaaccactaatctgttttccacttctacaattttgtcttttctagaatgctgtacaaatgaaatcttatagtatatcacgttttaagggcttattccactcagcataattccctggagattcatccaagatagtaatatctgtgtatcaatagttcattgttgctgttgttgttgagacagagtctcactctgtcactcaggctggagtgcagtggcatgatctcggctcactgcaacctccgcctccctggttcaagtgattttcctacctcaacctcctgagtagctgtgactataggtgtgtgccaccacaccctggtaatttttgtattagtcatagagacggggtttcaacgtattggcaaggctggtcttgaactcttgacgtcatgatctgcccgccgcaacctcccaaagtgctgggataacaaggtaagtcactgtgcctggccaatagttcatttttattactgagtagtattccatggtatggatgtacctcagttcaaccattcgcttattgtagaacatattgattatttccagcttttggctattacaagtaaagctgctatgaacaattatgtacaagtttctggatgggcatacattttaacttctctgaagtgtaattgttgaaatgtatggcaattgcatgtttagttttataagaaactaccaaactgctttccagagtggctgtaagattttaccttcccagcagcacttaatgaggtgtccagtttctctgcatccttgtcaccatttggtgttgtcactatgtcttttatttcatctattgtaataagtgtgtagtgatacctcatcatggccttaacttgcatctagtgaaggaaatgagggctgaacatcttttcatgtgcttatttgcttatttcctcttcagtgaaatatatattcacatcttttcatgattttctaattggattatttatttgtattttttaccattgaggtttattattattattattattattattattattattattattattcttgagacagagtctcgctctgtcacccaggctggagtgcagtggcacgatcttggctcactccaacctccgcctcccaggttctagcgattctcatgtctcagcctcctgagtagctgggattacgggcacgcatcatcatgcctgtctaatttttgtatttttagtagaggtgggtttttgccagttgcccagactggtctcaaactccaggcctcaagggatttgccctccatccacctcgacctttcaaagtgctgggattacaagcgtgagccaccatgctcagcctaccattgagttttgagagtactatacatatccattatatattctggatgtgagtcctttcttggatatgtggtttgcaaatattttctcctagtcaagatcctgttttttcatccttttaacagggtctcttgcagagcacaagttttaaattggatgaaatctgatttatttgttttccttatggattatgctttttgaacccttcactatgccctagatctcagacgtttgtcctatgctttcttctaaaagatttttttagttttatattttagatttaaatctatgatccacttgagttattttttgtataaaaatatgaagattaggtcttttttttttttttagcctatggctctgcaactgctccagcaccatttgttaagcagacgatccttccttctttttgtctcggtaaaaaatcagtgtggggctatttctaggttctctattttgttcccgtgatctatgtgtctatccttctcccaatactacacagtcttgattcctgtagctatataagaagtattgaaatatggtagagccattcctcccaccttattcttcttttccaaaaattgtctgagctacatatatatattttgagatgcagtctgactcgtgttgcccaagctggagtgcggtggggtgatctcggctcactgcaacctccttctcccgggttcaagtgattctcctgtctcaccttcccgagtagctgggattacaggcatgcgccaccacacacagctaattttttagtagatagggggtttcgccatgttgaccaggctggtcttgaactcctgacctcaagtgatctgcctgtctcggcctcccaaagtgctgtgattacaggcctgagccactgcgcccagggttgtttaagctattgaaaatttgttacagcagcagtcaaaaatgaaaacacatggaaacatttattagtgaaacaaaatagaaagtcaagaaacagactaatctatatgtaaacttcagcatgcatttccaaacagtgggcaacagacgatgggttgtaaaataaatgattgcttgacaagtgtctatccatttcaaaaactaaagattaaatccttactttgaagcacataaaataataaattctaaaaattcagtgacttaaatgtgaaaacctgaaatcataaagaactagatgacaatttaggaaaatattacagcgtaagacatcttgagttggcataggcacttcgtgacattactccaaggctatacacaatgaatctgacataaagatgtaaaaattaaagtatcatctaattcaaaagacaccataaacaactgtttaaaaaggcaaatgttggggaaattggtgaagcatccccaataaactaacagtaactatctctaacatacaacaaagcttttgcatatcaataagagaaactggaacaactcaatgaaaaaatgtgttcaggcatggcactacttcactgtatagcagaaaaggattatgaaatagaaagtatggaagaaaaataataaagaaaatggagaatagatcccagaagtttcaacattcatccaatagaagttccaaagataggccaggtgtagtggctcacgcctgtaatcccaacactttgggaggccgaggtgggcggatcacctgaggtcgcaagtttgagaccagcctggccaacatggagaaactccatctctactaaaaatacaaaaattagccgggcatggtggcacatgcctgtaatcctagctgctagcagtgctgaggcaggaggatcacttggacctgggaggcagaggttgcagtgagctgagatcgtgccactgcactccaacctgggcaacagagcaagactccgtctaaaaaaacaaacaaacaaacaaaaaagttccagaggtagagaatagaaagactgggccaggcgccatggctcatgcctgtaatcccagcattttgggaggccgaggcaggcaaatcacctgagctcaggagtttgagaccagcctgattaacaaggtgaaaccccatctctactagggtttggtggtgggtgcctgaaatcccagctatttgggagttcagaacagttcccagtaacaaaacccttgatggtttggccccactggggaatgagatgtcttcgaatgggaaaaggtcagaggccacagatggagcatcagcccaggtggagctttctaagttgcattcttgttttctccttgttttctggatggcttattacctgttctgtaaacatatagagcagacacttggcagggctggcccagtggcagccaaaagtggcgtgataacattaaggaatagggggcttggaaatctagaaaaagtgcagactcatcaaagctgcccagtaactgagcattcctttcctacctcttcctctgccctctgagctaggcaattacaaccaatatcacccacccatagactccctccactctgtaaggcagaaatcctgtaagcgtctctgggggctaataggctaggaactgaaaagaattggctcagctcagctccagaggctctgtatcctatgacctatcaatccagaaaccctgaaactcatatggagtgtctgggctgacacatcttcccaggaacaaagagttatatagaaaaactatcagataggcctggtgcggtggctcacgcctgtaatcccagtactttggaaggccgaggtgggacgatcacctgaggtcaggagtttgagaccagcctggccaacatggcgaaaccccatctctactaaaaatacaaaattagctgtgcgtggtggtgcacacctgtaagcccagctactcaggaggttggggcaggagaatcacttgaacctgggaagcagaggttgcagtgaggtgagaccacaccattgcacttcagcctgggcaacaatagtgaaactgtcttaacagcaacaacagcaaaaggccgggcatggtggctcacgcctgtaattccagcaccttgggaggctgaggcaggcggctcacctgaggtcaggagttcgagaccagcctggccaacatggtgaagccccgtctctactaaaaagacaaaaattagccgggcgtggtggtgggcacctgtaatcccagctactcaggaggctgaagcacaagaatcacttgaacctgggaggtggaggttgcagtaagcaaccttgcttactacggtggctggatcccaccactgcactccagcctgggcgacagaggaagactccatctcagaaaacaaaaacaaaaaccaaaacctaataaatgcagttaggaaactatcttaaaacacaaaatcccctttttttagactgattgtttaaaagataaagaaaaaacagatcaacatgttaagaaaacctaattcaaaacgagaggagtagactcgccctgcttcattgcacccttgacactaatggtcgatttttagataaacggatgaacaatttcttttcaatcacaaccaatctgatcatatataagactccattcccaaggctcatccttcataaaccctcagcaacttgcctagagattccatcattttttatccccagtcttagtcccataatttttcatttttatattggactccaattcaagttctagtaaaatgttagaggaaaaggataaactgaggaaaggactgttaaacaaaaaggatccagggaaattctaagcctatcaagattgcaaaagacactaaaattaggagaggcactgtcaggaaggtatcctctagagagaaagtcaagaatgtggccatgtttgctagtgctgaagagattaggcacgtgactcaaggagctcttccactatgctcagccatagccagtctagaaatgatattatctgggaagatacacataggacctgctggtctaaaggtgtgaatcactatgacatacattctgagaggagggcgatgggagaggggagagcttcaagctacagaggattattctgagtccttgaaaccaaatggaatttgtcctgctagatttcaaaatggttggaagtggcaactccttccttccattttctcccatttgaaatagaaatatctgtaactattatcctacatctgtctcgccactttatttttggaataaataacttgctttctagtgtcacaaattcacggcaggagaattttgccccaggatgtttcataaccagagtctcatccatatctgttttagatgaggagatttggtacttttgagctgatcttatatggataagatgttggacttcagctaatgttgcacggtttgagacatttgaggatttggggatggggtgcatgtattttgcatgtgggagagatgtgaatacttgggggccagagggcaggctgtggtagactgaacaacgcccctccaaaagatagcaacatagtaacacctggaacctgtgagtgttagc[134 bp omitted]gtctctgctaaaaaaaatataaaaattagctgggtatggtggcgggcacctgtaatcccagctatgcaggagcctgaggcaaagaattgcttgaacccgggaggcagaagttgcagtgagccaagatcatgccactgtactctcgcctggtcaacagagtgagactccgtctcgaaaaaaaaaaagtaattatgttaaagctcttgagatggggagattctcctggattgtctggattatctgggtgggccctaaatgtaataatgagtgtccttatcagattaaggcagggagatctgacacagacagaagagaagaaggcagtaagcctgccatggtttgaacgtccccaccaaaacttgtgttgaaatttaattgccattgttaacaatattaagaggtggggctgttaggaagtgattaatgccattatcataagagtggattagttatcacgagattgggtttgttataaaagggagcttagtcacattttctctgtctgtctcctgcacttgcttttgcctttcatccttccatcatgacacaaccctcaccagatgccagcgccatgttcttggactcctagcctctagaactgtataccaaatgaacttctatcctttataaattacccagtttgtggtattccattatagtaacagaaaacaaacgaaggcaatgaccatggaggtagagattagagtgatgcagccatatattagtcccttctcacactgctataaagagctgcccgagactgggtaatttataaaagaaagagatttaactgactcacagttctgcatggctggggaggcctcaggaaacaatcatggccaaaggtgaagaggaagcaaagactttcttcgcatggtagcaggagacagaaatgcaagcaggggaaatgccagacgcttgtaaaaccatcagacctcatgagaactcactgtcacaaaaacagcatggggaaaaccacccccgtggggatttgtaatctgtggggattacaattcgagatgagatttgggtggggacacagagccaatccatatcaagccacaagccaagaaatgctggcaatcacgggaagctggaagaggcaaggaacaggttctctcctagagcctctggaggactacagccctgctgacaacttgatttcaactcagtgaaactgatttcagatttctgggctccagaattgtgagagaataaattgatgttgtttatgccacaaagtttgcggtaatttgttacagcagtcagagggaatatggggtgattgtaaggagttatgtaaattatgttaaagaacctttgcagttgtaagatgcattcattcattcaacaagtagtcgaggcaatatagaagagtaattaaaagcaccgactttgaggccgggcgtgggatggttcactcctgtaatcccagtgctttgggaagccaaggcaggaggattgcttgaggccagcagttccttccagatcagcagggacaacatagcaagaccccatctctaaaaaaaaattattttaattaaaaataaataaatacataaataaaagcacagactttggactcaattctatcttgggggtgaatcccagctctgtcacccactgactatgtgactttgagcagactgcttaattctcttgagcctcagtctcaacatctgcatactggggatgataatagtatttaactccagagaaggttgtgaaaattaatgggaagatgcacataaaaggctttgtgctgggctcaagggccattgctctgttcctgccctaagagagcttgctgtaatcctgggaggatcttagagagatcagggctgtaggtggaaagcccagagaggaatggggacttgttggaggtactagggatgggggtaggggaaacttcttagacaaattgacttatgagctccctgatgaacacagtgggccctaattacatactctttttaatactattattataaatattattaatatcaatgggtaaaatatatttctgcttctttggtcttttagaaaaaaacatatatggaagtgtagaagtgtttttttttgtttaaatttcttttttaaaaattttttatagagatgggggtctcactatgtatcccagattgttctggaactcctggcctcaagtgatccttccacctcctgcctcagcctctcaaagtgttgggattacaggcatgagccactgggactggctcattgaaatttttctttctttctctttctctctctctctctttttaaagacaagatctcgctctgtggcccaggtaggcaggagtagccagatcatggctcactgcaacctcgtactcctgggctcaagctatcctcctacctcagcctcctgagtaacggactacaggcacaccaccccacctcgctaattttatttattttttttgtagagaaaagagacagggtattgctctgttgcccagggtggggtgcagtggcatgatcatggctcactgcaacctctgcctcccaggttcaagtgatcctccagctgtggcctccctaagtgctgggattacaaccgtgagccgccgcaccggcccaaatttcttacgtcactacagagttcctaggaaaaaatcccatacctgaaaaagatagaaactgacaggaaggatttgagatgatgacctgcttcatatacactccttattaaaactggataacaatgcaccaccgaggaggtggggagggataggaaaaatgaaaagagaaaatcagcgcatgcgtactctgatttgggaagactccaaagagaaaatcagagcatgcgtactctgaacttggagtagccaatcccaggggatgctttaggcgggaaagtcagagtttctgcctccattttgagaaggttctgtccctagagcctagactgatagaccccacatcagcttggcttgtcccgcctactgttctgacttctgattggccagatggagttcactaactgccctgattggtccatcatcctggagcaatgacattgcagaatattttctcctcctccagccacactttgtcaccaactgctgccaactcgccaccactgctgccgacctcgcaaccactgctttgtctctgaagtaggttctctttaagggacaccctagatgggctaatcggggcagatagaaaaggaggaagcctctgtagggccgtcaagtgcttggggttccgaaaatcttgaggactgaaagacaactaatgcctttcaggacgatcatcatggaggatcctcccgcctcggccttgggtctacaggcctgtattatcccacccctgtttttttttttttttttttagtagagacggggatttgttatgttgaccaggctggcctcaaccgcctgggctcaagcaatcctcccgccttggcctcgggactacaggcacgaaccaccccaccctcactaattttttttattttttatttttttagtacagacggttttgctatgttggccaggctggcctctgccgcctgggcttaagcaatccttccgcctcggccctgggactacagaagtgcaccatcctgcccatgctttttttttttttttttttagtagaaaccaggtttcactatgttggccaggctggcctcaacctcctgggctcaagcgatcctcacaccttggcctcaggactacagatgtgtgccattccgcccctgctagttttgttgttgttgttctttttagtagagacagggtttccttatgttggccgaactgggcttgacctcctcggctcaagtgatcctcccacctcggcctcggaactacaggcaagaaccacctcgctgatgttattatttttgttgttattattagtagtagaaatggggttttgctatgttggccaggctggcctcaacctcctgggctcaagagatcctcttgcctcggcctcggaactacaggcgagcaccaccccgcccccactaatactttttattttattttattttttttagtagagggtttttctaggttggctaggctggtatcaacctcgtgggctcaagcgatccgcccccccttggccaaagagctgagatgttataggcctgtgccaccgcccccagctaattttttgtgtgggtgtttttttttttttttttttttttttgtagagatgaggggtttgctatgtttcccaggctggtctcaacctcctgggctcaagagatctgcacgcctcggcctcccaaaatgctgggattacaggcatgagccactgcgcctggccgattgctgcaaattgaaacaccccacattttctctaagtgatggcaggctcttgtaatctcagagattctagctctcttccttctaataatttacaaataacccagtaatagcttctaaatctgttcatattagtgaaggtcatttctcttcaacagaacagaacccccccatccctctgcctgatcagatccatcaccagaaagaccacgttatgtctgggactcacttccctccctttatttattgagtgggggtgtcagaacgcccccattcaataaaattacacagtcacgtccctgcctccccagcaagggtctgtacatctttcagggtaagcctagccccagggaaactactaacaacactagccaaccccctcccaaagactcaaggctgctaggaaacctgtcatccccaagcaatacttctcccagagactccaggctccctgttttcatctgacttctctccatgtccttacccatggacaggtaagccccgaatggagaaatgcaacccctaattccaggtgactgagtgtggccgggcttcactgatttctccctccataggaccaagggtcctgtagctagaaagtctcaggctgtttctcttgcaggtgagactgctcctggtgccatgaacggagacgacacctttgcaaagagacccagggatgatgctaaagcatcagagaagagaagcaaggtgacgtgacctggagggggcagagcagtggtccaggggacagagtagggtgaccaggtttctgaggaggggaggacagaggtactggggacaaggagcagggtctcgggggagatctggacccttgggagcctcccacctgtgttctgtcatcacctagcatccctggagacaagtctctgaccttgctctacatttggtaactctcagtccattctggaaggtgggaagagagccagacagcagcattaaagccctaatgtgtgccacgggagaagctagggtaggtcccccatggtctctcagttagccatggcatcaaccaggacggattatcatcctcacttcccagatccagcacacaggaagcggctccagctgaatggcagacatacctagctgagtcactgacaaattttattttattttttttaggcctttgatgatattgccacatacttctctaagaaagagtggaaaaagatgaaatactcggagaaaatcagctatgtgtatatgaagagaaactataaggccatgactaaactaggtaacagaaagttctaggaacagacaagtctggggatacatgagcatcccttttcctgctttggctacttcttaggctgcagaaagtaccccacattttccttttgtgcagggaaaaatcgcaaggcagcttctgggggttctgctcttctgtatcctgtcagagctgagggcagggactggccatagtggagcttgtacctggaccttgcacttttctctcccttaggcgtctgttctgatcagcccagctgtctctgtggcattgcagcacacctcccaccctaccttcctcctctcagcttgtctctttctctctctctcccttttttttttttttttttttttttgagtcagagtctcactctgtcacctaggctagagtgtagtagtgcaatcatagctcaatgcagcctcgaactcctgggctcaagcaatccttctgcccagccgatggagtagctgaggatatgagcacatgcctccatgcccaactaattttattttataatttgtagatatgggggtctctctatgttacacaggctcatcttgaaatcctggcctcaaacaatcctcctgcctcagcctcccaaagtgccggtactacagacatgagccaccatgccaggcctaagtttgtcccttaaggaataaacattttgcttctttctaggtttcaaagtcaccctcccacctttcatgtgtaataaacaggccacagacttccaggggaatgattttgataatgaccataaccgcaggattcagggtgagtagatgggaagtggctggaaaggtctcctgaagcccaattgcttttcagctcagctacctgggaaagatcctctggcatttgttccctcatacacatcagggttgagtgaaaaaaaaaattgcatacagaaagttaactacagaggccattcataaaattctaaaacatgcaaaagtaatatgtactttcatggataataagtaaatggtaaatgcataaaaacataaatgcgaataaaaaggcatcagattgaggagactggctgtaaatggagaaggggcgggggcagggattggtgagtgctgcacagacagcttcagtcatgacttgttgatagtgtgttttgttttgtttcgttttgttttgtttttgttttgaactggagatttgctcttgtcgcccaggctggagtacaatggcacagtctcagcccactacaacctctgcctcccgggttcaaacgattctcctgcctcagcctcctgagtagctgggattacaggcgcccgccaccatgcccacctaatttttgtatttttagtagagatggggtttcaccatg[136 bp omitted]atctaacatagtcatggggtaatgttgagatgcgactgaactcaatattattccccatactattctgtgtgtttgaaacatttcttttttaaaagacatgttgttcttgctaaacactgtttttttttattatactttaagttttagggtacatgtgcacaatgtgcaggttagttacatgtgtatacatgtgccatgctggtgcgctgcacccattaactcatcatctagcattaggtatatctcccaacgccatcccttccccctctccccaccccacaacagtccccagagtgtgatgttccccttcccgtgtccttgtgttctcattgttcaattcccacctatgagtgagaatatgcggtgtttggttttttgttcttgcaatagtttactgagaatgatgatttccaatttcatccatgtccctgcaaaggacatgaactcatcattttttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgatttatagtcctttgggtatatacccagtaatgggatggctgggtcaaatggtatttctagttctagattcctgaggaatctccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttagctgcataaatgtcttcttttgagaagtgtctgttcatgccctttgcccactttttgatggggttgtttgtttttttcttgtaaatttgtttgagttcattgtagattctggatattagccctttgtcagatgagtaggttgcaaaaatttcctcccattctgtaggttgcctgttcactctggtggtagtttcttttgctgtgcagaagctctttagtttaattagatcccatttgtcaattttggcttttgttgccattgcttttggtgttttagacatgaagttaggcaggagaaggaaataaagggtattcaattaggaaaagaggaagtcaaattgtccctgtttgcagacgacatgatcgtatacctagaaaaccccattgtctcagcccaaaatctccttaagctgataagcaacttcagcaaaatctcaggatacaaaatcaatgtacaaaaatcacaagcattcttatacaccaacaacagacaaacagatagctaaacactgttaatgaatcaaaggacagttaagacaattttaaaagtgaaaaaaaaagaaactattaaaagtatagatccaccaaaaacttccagacattgtttcattaacagcatgtagatattggataaatatcttaagagagagggtgatgaacacatgtaataaagattgctgtttctccatactttattgaaaccaaatagtcttcacattcccaaacaaccccaattctccatgatgagcttggaagtgagtttgaaagagtgacccctcatccaacacacagagagctttcccaattgtcagtgagcggagataacataggatgaaaaaaagacaggttcttgggtagagatctttgtgcatttcaggaatagaaaggggacatatttgtttacttgctcttctgctctgacaatacaatcataagacaaggtcagagtgtctaaactgtcttcaatatctctattactccccagctaaacaggccagaatcaaccatctcccacaatcactataagagatctgaaactccagtgcttgagtatctgccaagttttgacattaaaggagtgtctttatactgaaaatatttcagagccactggactaaatcatccatggttcatcacacatttaacagcttaattcacataccataagatccacccatttgaagtgtacagtgatttttagttgttgcacatcttgagtgattacagtttacattcccaaccaatcaatttaattatttgggaaaaagtaaaagatatgtaatggaataagatgagactgtgatgggatttaacccccatttgagaaaccatgtgatgtaaaattctgaattgatgccacagataaatgaaccaaccatgactaaacataattcagaagcaaatctcaaataactcctcaacaatgagtggactcataacctctgctgcagaatgccctcatgcaacggaagtctctccagagtttggaaatctttaccaacaaagaaaaattctgatgtgttctctttcagttgaacatcctcagatgactttcggcaggctccacagaatcatcccgaaggtgagtatctctcaaatctaaaggaccagagaacctttttcctttcatggatgtgaacactgataagacagggagaatatcaaaaacgccctcattgcctctttctccccatgtctatcacaacaacttatgtagcaccgacggcttgataatactaacagttgtgatccttaatacttcttttgttttcatagtgatgccagatactattttaagcagttcacatggattaattaatttaatccataagaagacctctatgacattgtttcttttattatctccaaatagtaatgagtcacacacttcggttgtcatccatataaaagccatgtgacttggcacaaatcttctaagttatcggagctccagattcctagtccatgaaatggaagtaaagaataatagttcatgttatagaccatagttatcagcaacataataataaaatgaggctatcggggtacagagatgttaaagaattttcctggggcacagtgtcagtggtagtctaatccagagctccaagccatttaaagctcattcacgtttgtatttgtttatgaagttcagatgttgctcactagggctttaccccatagggcctactggtgcttccattgagacacccactctcgcaacaggaaggaccagctggcctctgctctgttaccggggccactcccatggcttaggaatcgctttgactgttggcccctccttgagctccttgagggctttgtctgcacctggggcatccgagaagccccagtcccagcccaggggatccctcagaggcccctgaatgagtgattctggaagtgcagattcagctctggtttagaaggtaaagggatctgggagttgggttgccagtatggagaacgaattcaaagaaggatccagaaaggtattcaatgttattattattacatttgaacaatgtttacaagctcagagaggattttcccttagcttattttacatgtattattcactatttcataagtgaggaagctgagtaaaaagtagcttaagggccgggcgcgggggctcacgactgtaatcccagcaatttaggaggttgaggcgggcagattacgaggtcaagagatcgagaccgtcctggccaacatggtgaaacctcatctctactaaaaatacaaaacttagcagggcgtggtagcgcctgcctgtaatcctagctactcaggaggctgagacaggggaatcgcttgaaccggggaggaggagattgcagtgagccaagatcgcaccactgcactctagcctggtgacagagcgagactttgtcaaaaaaaaaaaaagagtagcttaatattgttggtcagtgacacatcccagtgtaaccagaattggtatgggtaccacctcactgaattccacattcaatgttggtgcctcggtagggtggtatgccagatctggtactgctttctttgctgcctagattaatttcagcaaaccatttctttacctctcccttccctgtattcatctccccacaccatctttcccagcagtgttttgtcccctccctatgtttttacatttactctcccagcagctgtctacgagcttatatgggatcccttgtattttatagaagctcttccttttgtagaccttgtgaattcttagaatgctatttttctccaaatattctgtgtactacactctcaactacatggagatttctgctgtttccacgaatgtcagtcttaaaagagtgtgaagataagcattctagccctggaaactgcattcatttaggccattccttttgcttctaatctcccaggtttgtctcatttaggcaagtgtaactctccccgcgttgttgagaacattcattaaggtaatgcatgtgaagacgctttgtaagctctaaagcactatagaaatgtcactgatactgtttatctgtaaccttcacattataaagatcatgcccaagaagccagcagaggacgaaaatgattcgaagggagtgtcagaagcatctggcccacaaaacgatgggaaacaactgcaccccccaggaaaagcaaatatttctgagaagattaataagagatctggtaagaggaaatgatttgggaacaacttctctggcttttctggctatgttcaggtgtgtggactgggtgtgtggcatggatcccagacaagcctgggtccaggctgggctgaagagctcgcccagctccagatgagatgttagacatgacttccagagatgcagactggagttgtcatccatataaaaaaccacgtgacttgggacaagtcttccaaattttctcagctccagattcctagtccataagatggaaataaagaatcatagttcgtaaattgtttggaggcattaaattaaatcctgaaggcctgatgacatgaaaggtgctcaagcgattctatctgtgataacctgggatcatatcttactcagctcaatgcctgatacccaatacaggtgtacttcagagatattgcaggttgggttccagagcactgcaataaagtgagtcacacacattgtttttcgtttgtttcgcagtgcataaaaacattatgtttacactatagtgtactctactaagtgtgcaatagcattatgtctaaaaatgtacataccttaattttaaaataatttattgttaaaaaatgctaacaatcttctgagccttcagtgagttacactcttcttgttggtggagggtcttgcctcggtgttgatggctgctggctgatcaaggtggtggttgctgaagggtggagtggctgtggcagtttcttaaaagaacacaacaatgaaatttgccacatcgattagctctccctttcatgaaagatttctctgtagtatgtgatgctattcgatagcatttagccactttagaacttctttcaaagttggagtcaatcatctctagctatgaaagttttagatggcatctacttccgataaaaggctgtttaatctatattgaaaatctgttgtttagtgtagccacgttcatcagtgatcttagctagatcttctggataacttgctgcagcttctccatcagtgtttgctgctacaccttgcacttttatgttatggggacagcttctttccttaaacctcacaaaccaacctctgctagtttcacacgtttcttcacctctctcagctttcatgggcttgaagagagttcaggtcttgctctgaattagactttggcttaagggaatgttgtggctggtttcatgttctatcctgatcactcaaactttctctattgcagcagtaaggctgttttgctttcttattcttgtgttcactgggtattagtattattatttccttcaagaacttttcctttgcattatatactattctttctttcaagaacttctcctttgcatgcacagcttggctatttggtgcaagaggcctagctttcatcctgtctcggctttcagcatgccttcctcactaagcttagccatttctagattctgatttaatgtgagagaatgcgactcttcctttcatttgaacagttagtggccattttaggattgttaactgtcctaatttcagtatcgctgtatctcagggaataggtaggcccaagaaaaggaaaagagatggggaagagctcattggtggagcagtcagaatacacacaacattgatcaattacgttcgttatcttctctaggtggagttcctgttacccccagaacattgacacacaacagggtgactatagtcaataataacttaatcgtacatttaaaaataacgaaaagagtgtaattggattgtttgtaacacaaggataaatgcttgatgggatggataccctattttccatgatgtgattattacgcattgcatacgtgtatcaaaatatctcacgtaccctataagtatatacacctactgtgtatccacaaaaataaattattttaaaagactaaaaaacaacaaaaacaattgcaataataacatcaaagctcactgatcacagatcaccataacagatataataataatggaaaagtgtaaaattggtgagaattccccccaaaaaattacagtgtctgcatagcactataaaaatgaggtgccataaaacaaggtatgcctgtgtgcccttaacaaatacgtgctgaatgaaaggaggtatcggtgaatgttcccgtaagtgaagaggttggtaatctaaacgtcacaacagaaggagccagaagctaaaacattaattggtatttgtcgtgtattggtgtgggtctaaggcctcagcctctctaagccagagaatgtgaaaaactggataaagaaggcccatgggcacttgggagggaggaggcatctcctttttttgagaaaacagagcctaacactcttcaacgtacccaaccctcatcttccaactcttctccatcataggacccaaaagggggaaacatgcctggacccacagactgcgtgagagaaagcagctggtgatttatgaagagatcagtgaccctgaggaagatgacgagtaactccgtaagtgaaccttcggctcaccctccacatccctgcagatgtgctattctgttatggtactggtatcccatcttgtcatttgtttcccaaatcattcctttctcataattttctactgtacagcattgaggctgaatgatgagatttcccatgctctttctactccctaccctgtatatccagggatcctcaccacccaggatgctgtgggttcccaaaccccaggtcagccctgatatgtggccacaccttcttctagcctaggaatgcataaaccaggcgaggaagtcactgtggcatgagcagatggttcacttcgaggaaccatggaaggcgtgtccaggtcctggggtagggcagaatcagagtgtgcagggtctgcaggtcaggaggagttgaggttgagttattgggcagtgggaactcgctgtcacttactttccttccctcttctcgcctcagcctgggggatacgacacatgcccttgatgagaagcagaacgtggtgacctttcacgaacatgggcatggctgcggctccctcgtcatcaggtgcatagcaagtgaaagcaagtgttcacaacggtgaaacttgagcgtcatttttcttagtgtgccaagagttcgatgttagtgtttccattgtattttcttacagtgtgccattctgttagatactatccttataattgatgagcaagacatactgaatgcatatttcggtttgtgtatccatgcacctacgtcagaaaacaagtattgtcaggtattctctccatagaacagcactatcctcatctctccccagatgtgactactgagggcagttctgagtgtttaatttcagactttttcctctgcatttacacacacacacacacacacacgcacacacacacaccaagtaccagtataagcatctcccatctgcttttcccattgccatgcgtcctggtcaagcccccctcactctgtttcctgttcagcatgtactcccctcatccgattcccctgtatcagtcactgacagttaataaacctttgcaaacgttccccagttgtttgttcctctcattattgtgcacacagctttgtgcacatgtgtgaatatttctttagaaagattcttagaagtggaattgccatgtcaaaggagtcatttattcaacaaaaccctaatgagtgtgtcctcgtgctgagcgctgttctaggtgctggagagacatcagggaacaagacggggagatgttcctgaccaccattctagaggaggatgtttccagttgttggctttctttgtttctttgtttgtttgtttcttctggagatggggtcttgctctgtccaggctggagtgcagtggcacgatcatagctcaatgcagccttgaactgctgggctcaagcgatcctcccaccttggcctcctaaagtactaggattacaggcatgagccaccgcgcctggcctccagtttttattttgatagggactatacacttcagtcctggagcaggattctgcagcaggtggttgggcaatttggccttcgctctctgaacaattttcgggttctagggctgggatggtccatttgggagtatgtgggaagagacacagatgaaatcgtcatctggggaacatggaggaatgaggaagatgcgtgcactgtagaccctgtgatggccagggaatagaagagtccacttagtctccatgcaggggagcaacggtgggaaggtcccctggacagaagcatgagactgcccatcaagggtctcaccacccaagggcctgggggctggggtggggacgatgatttgggaatgggacagttctttctcacaggtaccaatgcacggtgcagaggggaaacagttgtggggaagggaagggcagaggggagtctattttagcacaaagcattgtgtgtgaatggagacatcaaagctccattcacacaccatggacttgaaacaccagccccaggtggaggcaggattggagctgttttgaccgtccatagcccatcaccttggcctcctggttctcccagccttagaaggagcacactatgatcattatgcctatatgacagatgagagacggagtcccagagagatggtaggcgtcttgtcacaggtcctacagctggcaggtgcaggaggagctgagtttggagctcactgacttcagaaacattaaggaggacaggtgtgtgtggtggaggaagggagaactgaacaagtcccgggttctgtcccgtcacaaggtagaggctgtgggttcattttccaagacaaggaacccttagagatggagagtgcagggaggaagaggcaatcgtggacatagtgggacagtgggagacagagatgtgcagcgtagggagaagaggggcaggcaaagaagcaggggatacccaagaccaagtgtgggctgtcacagccaccagagggagagggtgccaggaaggaggttgtggggctccaggagcaacagaggttccccagatctgtgagcacgccctgcctggcactgcaggaagaggtggctgccccccaggtcagtgtggacgtgcctctacctgtgtctcagaggaaacaaattctattttatcccaatatagttctgtattacacaaatgtaacattcggctactagatatcaggtgccttatcctccatgcaaacagaggagaggatacccaaaaagagatactgaaggatttggtttttctttctccctgggatgatgggatccataagttgggtcccccagcccacaagacaggtgccaggaagggtgactggaagagtgtgagtcatgacagggaacatttttccttaggtttcttgggtatataaagctcccgactgtctatcatggatagataaagagtgaacatggtcccctctccacaaatgtgtttctttcc[134 bp omitted]ctaccaggttcaagcgattctcctgcctcaatctccagagtcgctgggaacacaggcgcgtgccaccattcccaactaattttttatatttttagtagaaacggggtttcactgtgtcagccaggttgatcttctggcctcgtgatctgatggcctcagcgtcccaaagtgctgggattacatgcgtgagctagtgcgcccagtgatgcattacttttttatgtctgtgtttttttatattttattttttatttttttattttttttgagacaggatcgcactctgtctcccaggttggagtgcagttctgcaatttcagctcactgcagcttcgatctcccaggctcaagggattctcctacttcagcttacgaactacctgggactacaggcacttgccaccacacccagctaatttttgtattttctgtagagacaggatcccactatattgcccaggctggtctctatctactggcttcaggcaatcctcctgcctcagcctcccaaagtgttaagatgacaagtgtgagccacctcgccaggccttcgctttctttaatgaacaattatcagagtttcatcttagaggcaaaagtggctactgccagccaatctgagtgttgtgtcggaggggaatctggctggttcagacgtttcaaatgaacttttaaattaacctacctgatgattaccctaaggccctttctcgctccatgtttttttgattatgggtttggagtttttcagaagctttcctacaaagaacatctcctgactgggcgcagtgactcacgctgtattcccagcactttgggaggccgaggcaggcagatcacttgaggtgaggagttcgagaccaacctggcctacattgcaaaaaccctgcctctaccacaaatacaaaaattagccggccatggtggtgggcaccggtgaattccagttactgcgggggctgaggcatgagaatcacttgaacccgggagatacaccgtgcagtgagccgagatcacgccactgtactccagcctgggcgacagagtaagtccctgtctcaaaaaacaaacagcatctctcgcctacagtgatttgagctgtggtcttgtctcctcgggtttctctgtcagtctgatcccatctactctatctcccaggaatgcctcaatatatctggtggaccactgacacgttttcctattttcctctactgttaaggattgacccttgaaaacattttcttcctagtttgatggaacgttgagtggggcacgggatctagctgccatcttgctccaatcatctgttattagatatttcatgtattttttgtcacaatataagtgtaatttttctcaatttggttttctaaatggctattattggcatgtagaaaccctatctattattgttaataatattttgttacctgtctgggtacagcttcccctgtattttggcacaagactcaatctattttattcttcaaaacaaaactgacaggctgagtgtggtggctcacacctgtaatcccagcacttagggaggccgaggtgtgtggatcaactgaggtcaggatttcgagaccagcctggccaagatggtaaaaccccatctctactaaaaatacaaaaaaaaaaaaaaaattagccgggcattggtggtgcacgcctgtagtcccagctactagggcagctgaggcgggaggatcatttgaactcgggaggcggagatcgcagtgagccaaggtggcaccactgcactccagcctcgtggacagaaactctatctctaaataaaaagaaaaagaaaaaaagaaaattcacttcaccggcaatagatagttataaaaggataatttatggaagatttcataggggagactgatggaaagaaaggaagtatacattttacagagctgagcagttcactgcaaaaatcaccagaactgcctttttctccaaaaatgctacccataagctattctactactggttcttctagtccttttctctattccaaatcctcaaattgtccatttccttattggggtaattttcctctgcccagatctgggtcctccaccacacttaacactgtctgcgagtgtgtgaattcccattattttagctcaggttcccaaggaaacaggctttgggccatacaggacacctctagacagactatactgagaagccatgcttggaacggtgcatggggagaggagagggaatttacgtacctggctctcactcatggtttttttttttttaattggtcaaaatttaccccataggcatgaactcccccacacttctagattgcatcatctgcccctttcacagctgtcttggaagccagatcccacactttgaagtgtagtgtttcatagaaaccaaaagtggtcctagaggccaggtgtggtggctcacgcctgtaatcccatcactttgggatgccaaggcaggaagttcatgaggtcaggagtttgagtctagcctggcgagcatggtgaaacccagtctctactaaaaatacaaaaattagcccggcatggtggcacacacctgtaatctcagctactcgggaggctgaggcaggagaatcgcttgaccctgggaagcagaggttgcagtgagctgagatcgcaccacggcacttcagcctgggcgacagagcaagactccatctgaaaaacaaaacaaaacaaacaaacaaacaatcaaaaaagtggtagcagaaaccagaaagtccatgtatgtagctaattggcctggttgtatagcagcagccaagggtgaaaactaaatactcccagacaagttctaagttcaccaaggaattggagtacccatctgtgctagttaattgcctttatctgaaggaaaaataaaactcatatctctatgacaagcaggtgcttagagcttggagaaaggcacctaggcaaactcccctggtgacagggagactgggacgtcatcttcctcaatgttcacgtttcaaagagatggctcaaggccctgaagaaagacctttctagggactggtcatggtggctcacacctgtaattccaacactttgggaggctgaggctggagtatcacttgaggcctggagttcaagtcgaagacattcctgggatatatggggccagaggcttacatatcaaaggaagaatttaccaatacaaattttctgaaggaaatgctctagggaaagggaaatgggaaaaggtctcttcttcccttttggcaacaggaaaatctcaattttatgtgtagttaaccttacaatttcccccttttgttattcttttatagtaacattacaattttctaattatctccactgctgtttctatctttctctgggtagtgtacagccacatagatatccaacaagtccatagtaagatgcaaagcaaagcaattatcaggattataatagaatgacttttttttttcgggacagagtttcactctcattgcccaggctggaatgcaatggtgcgatctcagctcgctgcaacctctgtctcctgagttcaagcgattttccttcctcagcctcccaagtagctgggattacaggcatgcaccatgaagcccagctaactttgtattttttgtagagatggggtttcaccatgttagccaggatggacatgaactcctcaccccaggtgatccgcccacctcggcctcccaaagtgtgaggattacagacgtgagccaccatgcccggtctagaatgaatttttaaattcagtgtaatactcacctcgtcagggggcggggcgaccattcaacacatcatagtggttaattgtgtcaaagacaaaataaattatagagacaaattcctaaatcaaatgctgtatttgggaatcacaaaattgcaattcagggcatatacacggactggggtggtcttcagtatgtccaacgaacaaacagaagttggaagctttatcggaaagaaaaatgttacatattgttttgaaatgaggctcactggccctggagaagctggttcatttgcacaatcagttttaaaattccctcttttgatgaagatctttctttcaaaacctcactgatcagccatcttaaagtgaggcttcattgtcactccatgccaggatggacctgtgccggttgtctttgtcccatgtcaagggaaaggtaagggagtctatatcaggaacatgggccacatttgagccacaaagaggccagaaggaaaaaaaaatcaggcatgtttgtttggagttcagcatcttattagttccatctatattagcattcatcttgaagcactaggccaacattatcctgttgggagaactggctgaacaaatattagacaggcaacaagaacagagctcaaagatcataatacaaaaataattagcaatctttttttttgtttgttttattttattgcaatggagtcttgctctgtcgcccaggatgaagtgcagtggcatgatcccggctcaccgcaacctccacctcctgggttcaagcaattctcctgtgtcagcctcctgagtagccaggattaaagatgtgtgccacgaagccctgctacatatttttgtatttttagtagagatgtggtttcaccgtgttggccaggctggtctcaaactcctgatctcaagtgatctgcccacctcagcctcccaaagtgctgggataacaggtgtgagccatcgtgcctggccctataaccaatgtttttaattgtatccgtctataaagagagagcagatttttttgtgtgtgttaaaaaaaaagtgggccaggtgcaatggctcacacctataatcccagaactttgggagagtacttgagcccaggagttcaagatcagcctgggaaacataactagacccccatctctgaaaaaaaaaaaaaaagaaaaagaaaataaagagaaaagaaaagtaaagtatggttttattactacctgcatgaggtggtaggtgtgcttgagagaagggaagagaggaaaggaggggaggagaagacagggcagaggaggggagggggaggaggagaaggggggagagggagtgggaagctgcaggcaggaaggaatggttttattactgagtgggaagctgcaggcaggaaggaatggttttattactacctgcaggcagggcctgcatgaggtggtgggtgtgctgggcccagggtatgtgtgggctgtgagcagatggtgatggtgaggctggaaggaaagggggtggcttggaaaccaggcccaggggatcctcagatctgcttcttggaatgggcagccttgagaaaagagtcatggtaagccacagtcatgccatccatcagatgcagacattcttggaaatctaactgcccatcactagtgaggtccagtttcttcatcatgtggtcaaagacactggggcctctggttcttcgtgaaggcatctagttctctattcatgaagcttgggaactctgtcttggagtgaatgctattgtaaccatcctttccagcctatttctggaaaacagcaatcggactctctgtagggctggagatttttgccatgttggagttgaatgagacaccaagagcaggtttttactggacctgtgtaaataaccatactgccgtaagaatatttccaaatagtttcaaattctggaggaatcgagcagaaagaaaaagcaaatctttccatcttagtttacaaaagtacactttaccaaattgttataaactatagacagtttaacagaggaaattttctcttttttttttcattttttgagaaaggtttgtgccctgttgcacaggctggagtgcagtggtgcaaacatggctccctgcaacctctgcatcctgactcaagtgatcctcccacctcggcctcccaagtagctgggaccacaggtgcatgccaccatgcccagctaattttttttttttgagacagggttttgccatgttgtccagacttgtcttgaactcctgggctcaagaaatcctcctgccttggcttccaaagtgagccaccacaccccaccagaaaattttattaaatgtgcaaaaccaaacatttaagtaaaaaacaaagctttttttcttaatttcttttagaaaccaggtctcctatgttgcccaggtttgtcttgaagtcctgcactcaagggatccttctgtcttggcctctgagaatgctaggattacaggtgtgagccactgtgcctagctgaagaataaataaagttttaaataaaggtcataaaaacatcagttatttagcctcatgtaattttgttctgcttgatcttgatgatcaggtgcatgaacccatcagttttcattagagttttcaagaattatttagttcatttatctgaaagttattacaaatctatattcaatagtacttgttaaaatcttttttatgaatctgattctggatacatttagagaagaatcaacactgtagatgatacagcttagaatagcaatgattaagatctgatcaaaggtccataattgagaaaaaattcaattatttctattatgtagaacattttaagataagaaccagaatcatgactgatagcatcataccaggaccatcagagctctgtaaaatttatatgatcttcagaacattaacatcaataacatatttatataaatgtaaacagcaattagtgtattttattatttgaaattgcttttcatatcatctaacatatcaaataagcctaatgagagacacattctttgaggctctccgggggcctcactggtaaatctcactcaattttaggttaaaaagacttaaattagaatttgattagtttgttcgacagcaatagataaataaaaaagaattggattttggggaagtttgtcaaagatgttaaaaggctcaaaacacttgttcaaaacaggatcacgggtcactgtgaaataatagtcactcatttaaccagagttatagtcaacagacttcaaaagcaatacagaaagttacacagacttaaaaacttaaccctttcaaagctcagttttcctaagcaagaagaaacctaattagtgtagttaactttctgtatgcaacttttttttcactcagccctgatgtgtatgagggaacaaacgcctgaggatctttcccaggtagctgagctgaaaagcagttgggcttgatgagaccctatccagccccttcccatctactcaccctgatgcccatggttatagtcattatcaaaatcattcccctggaagtctgcggtccgtttattacacatgaaaggtgggagggttgccttgaaacctagaaagaagcaaaatgtttattccttaagagacaagcttgggcctggtatggtggctcatgtctgtaatactttctgcagcctaagaagtagccagagctggaaaagggatgctcatgtgtccccagacttgtctgttcctagaactttctgttacctagtttagtcatggcctcatactttctcttcatatacacatagaggattttctctgaggctttcatcttttcccactcttccttagagaagtatttggcaatatcatcgaaggcctacaaaaaaaaaaggaattatggcagggactcagctaggcatgtctgccattcagctggagccacttcctgtgtgctggatctgggaattggggatgataatccgtcctggttgatgccatggctaactgacagaacatggggggcctaccctagcttctcccctgccacacagtagagctttaatgctgctgtctggctctcttcccaccatccagaatggactgagagtcaccaaatgtagtgcaaggtcagagacttgtctccagggatgctagatgatgacagagcgagggtgggaggctcccaagggtccagatctcccctgagaccctgctccttgtccccagtacctctgtcctcccctcctcagaaaccgggtcaccccacactgtccctgggccactactgtatctcctccaggtcacctcaccttttgtatcttctctggtatttgagcatcaaccctgggtctccttgcaaaggcgtcgtctccattcatggcaccgggagcagtctgacctgcaagagaaactgcctgagactttccaggctcaagacctttggtcctgtggagggagaaatcagtgaagtccggccacactcagtcacctcgaatcaggtgctgcatttctccatccggggcttatctgtccctgagtaaggacatggggagaaatcagatgaaaacagggaaccaggggtctctgggagaagtattgatcggggatgacaggtttcctatgggcaaagcagccttgagtctttgggagggggttggctaatgttgttagtagtttccctggggccaggcttaccctgaaagatgtacagacccttgtttgggaaggcagggacctgactgtgcaattttattgagtgggggcgttctgacacccccactcaataaatagaggaagggatgtgagtcccagacataacgtggtctctctggtgatggatctgatcaggcagaaggatgggggtttctgttcttttgaagagaaatgagcattgctactatgaatgaatttagaggctattactgggtgatttttaaattattagaaggaagagagctagaatttctgagcctacaagagcccaccaacacttagagaga[133 bp omitted]aaactcccgtgtctacaaaaaattagctgggggtggtggcgcaggcctgtaccatcccagcactttgggaggccaaggtgggcagatagcttgagcccaggagcttgagaccagcctggccaacatagcgaaaccatctctactaaaaaaaaaacaaaaaaaagaaagaaaaaaaagaagaaacaccttagcagaagcggggtggcgtgtgcctgtagtctcaaggcctaggtgagaggatcacttgagcccaggaggaaagatttgagtgagctttttttttttctgatacatagtcttgctctgttgcccaggctggggtgcaatggcatgatcttggctcactgcaacctttgcctcgtgggttcaagcaatccaccagctgtggcctccaaaagtgcagggattacaagcgtgagccactgtgcccagcccaaatttcttaagttactacagagttcccaggaaaaatcccatacctgaaaaagttagaaactgacaagaaggatttgagatggcgacctgcctcacatacactccttattaaaactagataacaaatgcaccgcagaggagaggaggggtaggaagaatggaaaaagaaaaccagtgtatgcttactctgattttggaagaatcaaaagagaaaatcagagcgtgtgtactctgcagaagaatggaaagagagagaaaggcagagcatgcgtactctgcacttaaagtagccaatccctggggatgctttaggcgggaaaatcagagtctccgcccccagtttgagaaggttctgtccctggaggcgggactgatagacgccacatcagcttcgttcctcccgcctactgttctgacttctgattggccagatgaagttcactaactgccctgattggtccatcatccttgagcagtgacattgcacaatattgtctcctcctccagccacactttgttgccattgcgacagagtcaggagattttgatctctccaaagacctcccctggatcttgtgttaaacatctggattctagtctgaacagcgagaagaaaaaaatagtcggatctgtgatttttctacttgaaagacacaatgttttccaaactagcacatttgcagagctttgctgtacttagtcgtggctttcattcttcagtggcttctatatctgttgcaactgaaaaaacagtccaaggccctccaacctctgcttacatttttgaaagggaatctaagtgtggtgtgcacaattaccatcctttacctgtagccctggagagacaaaaatgtatttacttatgggatatgattgtggtattggttacatccaccttggccaatcctcccgcctcggtctcacaactacaggcacgaaccaccccacccccactcatattttttggtttttgattttttaatagagacggtttcactatgttggtcaggctggtctcgacgtcctgggctcaagggatcctcccgctgcagccttgggactacaggcgtgcaccaacctgcccatgatttttttttttttaatagaaaccatgtttcgctatgttaaccaggctggcctcaacgtcctgggttcaagggctccttctgccactgcctcaggactactggtatgtgccacctggcccatgctttatttgtttgtttgtttgtttgtttgtttcatttttagtagaaaccggattttgctatgttgcccaggctggtctcaatctcctggactcaagtgatgtttttacctcggcctcaggactacaggcgtgtgccattctgccttgctcatttttattttatttatttatttttttattttcatttttttttcggagaggcaggctttcgctatgttggtcaggctggtatcgacctcctgggctcaagcaatcctcccactttggcctgggacctgcaggggtgagccaccccgcccacgctatttttttgttgttcttgttattagaaatggggtttcgctatgttgcccaggctggcctcgacctcctggactcaagcaatcctcccccatcggccttgggactacaggctcacaccacctagcccccactaatatttttaatttttctagtagagacagttttgctatgttgtccaggctgttctctacctcctgggctcaagcgatcctccggcctcggccttgggtctacaggcatgcaccaccctgccttttgctgtttttcccaggctggtcctgacctcctgggctcactcaatgatttgaacccaggaatcggaggttgcattgagctgagatcacaccactgcactccagcttgggcgacagagcaagactgtcaaataaataaatacacgaaagaaaggaaaggaaaaaggaaaggaggaggaaaggaaaaaggaaaggaaaggaaaaagggaagggaagggaggggaggggaggggaggggaggggaggggaggggaggggaggggaggggaggggaggggaagggaagggaagggaagggaagggaagggaagggaagggaagggaagggaagggaagggaagggaagggaagggaagggaagggaagggaagggaagggcgaccagctgactctccataagaacagtaagctttgtggtattttaagttatcctggtcccgtctcgtgctcctagcttggttctgttcattgctgatgaaatacagataggattggccagaactggtagatggctggctgttgatcatgaaaatgtcagacctgatatagacctgcttggaaaggccctttctgggggctgacactcttgtgtctgcagtgctgtgggatgatgacataatgctgaccattaagccaggggaacgtgggtccacatacggtggcaatccactaggctgctgagtgaccatcgcagcccttgaggttttagaagaagaaaaccttgctgaaaatgcaaggtttttatctcaagggtattatcttgagaaatgaacccatgaagctaccttctgatgctgtgactgcggtaagaggaaaatgattattttatgtattcatttatttatttttttgagtcagaggttcactctggttgcccaggctgcagtgcaatgccacgatcttggctcactgcaacctccgcctcctgggttcaagccattctcctgcctcagcctcctgagtagctgggattacaggcacgtgcccctattcccagctaatttttgaatttttagtagagatggggtttcaccatgttggtcaggctgatctcgaactccagaactcaggtgatgcacccgcctcggcctcccaaaatgttgggattacaggcgtgatccactctacccaggaggaaaataattattaatttctattgttattaaagaaaccaaagattgtgatgcttggaaggtatgtctacaacttccagattatgggcttctggccaagccaacccatggtgacatcatcaggtttcgcctctgctggtggtcaaggaggatgagattcgagagtccagtgaaatcaataacaagaccatcttgtcattctgagggtagcagctgttttcactggtccctgggagccggctggagacaggtggtcctgtaaaagctctgctcttaatgcgggcacattccactcccatgtgtcttcaaaacctttttctggaatatatgtgtttttcagttgatacaaaaatctatgtttttctcagttgatatataatagaacaacatttttgaacctgccttttgctttgtaacataagtaagagaatgtaaaggcatctctattcagtgaaagtattttgatgtgcagaacatggctgggtgcagtggttcatgcttgtaatcccagcattttgggagggcgaggtgggcagatcacttgaggtcaggagtttgagaccagcctggccaacatggagaaacccagtctctactaaaaatacaaaaattagctaggcgagttggtgggtgcctgtagtcctagctacatgggaggccgagacaggagaatcacttgaacctgggaggcagatgttgcagtgagctgagattgtgccacttcactccaccctaggtgacagactgagaatccccttaggaggaaaaaaaaaaaaaggaaaacgaggtacagaacatttccatcaccacaatgctatcccttgtgctactcatttttagtaatactcactcttctcccatctaccacccctaacccctggcaacctctaatctgtttttcatttccacaattttgtcttttctagaatgttgtacaaatgaaatcttgtagtatataacgttttaggggcttatttcactcagcataattccatggagattcct[132 bp omitted]gattttcctgcctcagcctcccaagtagctgtgactacaggcgtgcgccaccacaccctggtaatttttgtattagtcg[142 bp omitted]tattccatggtatggatgtaccacagttctaccattcgcttattgcaggacatattgattatttccagcttttggctattacaagtaaagctgctatgaacaattatgtacaggtttctggatggacatacattttaatttctctgaagtgtaattgttgaattgtatggtaattgcatgtttagtcttataagaaactaccaaactgctttccagagtggctgtaagattttaccttcccagcagcactaaatgaactgtccagtttctctgcatccttgtcaccatttggtgactatgttgtcactatgtcttttattttagctattgtaataagtgtgtagtgatacctcattgtggtcttaatttgcatccaatgaagcaaatgagtgttgaacatcttttcatgtgcttatttgcttattccttcttcagtgaaatgttcacatcttttcatgattttctaattggattatttgtttatattttttaccattgaggtttattcttcttattattattattatttttcttgagaaagagtctcactctgttacccaggctggggtgcagggaatgatcttggctcactccaacctccacctcccaggttcaagtgattctcatgcctcagcctcccgagtagctgggattacaggcaggcatcatcatgcctgtctaattttttattttcagtagagatggtattttgccatgttgcccaggctggtctcgaactcctggcctcaagggatctgccctccgtcgacctcgacctttcaatgtgctgggattacaagcctgagccaccatgctcagcctaccggtgagttttgagagtactatacatatccattatatattctggatgtgagtcctttcttagatatgtggtttgcaaacatttcccccaggtcataccctttttttcatcattttaacaagatttcttgtagagcaaaacttttaaatgggatgcaatccaatttatttgttttccttatggattatgctttttgaactgttcactatgccctagatctcagatgtttctcctatgctttcttgtaaaagtctttttttagttttatattttagatttaagtctatgatccacttgagttttttttttttttttttttgtataaaggtaagaagattaggcctttttttttttttttttttttttggcctgtggatatgaaactgctctagcaccatatgttaagcagacaatacttccttattttgtctcttcgtaaaaaaaatcagtgtggggctatttctaggttctctattttgttcccgtgatctatgtgtctatccttctctcaatactacacagtcttgattcctgtagctatataagaagtattgaaatatggtagagccattcctcccaccttattcttcttttccaaaaattgtcttagctacatatatatattgtgagatgcagtctcacttgtgttgcccaagctggagcgcagtggggtgatctcggctcactacaacctctggttcaagtgattctcctgtctcagcctcccaagtagctgggatttcagctgtgtgccaccacgcctggctaatttttgtatttttagtagagggggggtttcgccatgttggccaggctggtctttaactcctgacctcaagcaatccacccgtatcggcttcccaaagtgctgggattacaggcgtgagcaaccatgctcggcattgtctaagctattgaaaatttgttacagcagcaatcaagaatgaatacacacagaaacatttaatagcgaaacaaaatagaaggtcaagaaacagactaatctgtatgcaaacttcagcatgcatttccaaacagtgggcaaaagatgatgggttgtataatatatgactgcttgacaagcgtctatccatttgaaaaaataaagattaagtccttactttgaagcacataaaataataaattctaaaaattcagtgacttaaatgtgaaaacctgaaatcataaagaactagatgaaaatttaggaaaatattacagtgtaagacaccttgagttggcataggaacttcctgacattacaccaaggctatgaacaatgaatctgacataaagatgtaaaaattaaagtatcatctaattcaaaagacaccataaacaactgtttaaaaaggcaaatgttggggaaattggtgaagcatccccaataaattaagagtaaccatctctaatatacaacaaagcttttgcctatctataagagaaactggaacaacccaatgagaaaatgtgttcaggcatggcactacttcaccgtatagcagaaaaggattacgaaatagaaagtacgaaagaaaaataataaaggaaatggagaatagaaccc[141 bp omitted]tgaaaccccatctccactaaaaatacaaaaattagccaggcatggtggcacatgcctgtaatcctagctactagcggtgctgaggcaggagaatcacttggacttgggaggcggaggttgcagtgagccgagatcgtgccactgtactccaacctgggcaacagcgctagactctgactcaaaaaaaaaaaaaagaaaagaaagaaaaaagaaaggaaaagaaaagaaaaaaaaagaagttccagagatagaaaatagaaagaccgggtcgggcgccatggctcacacctgtaatcccagcactttgggaggccaaggcaggcagatcacctgaggtcaggagttagagaccagcctggccaacatggtgaaacctcatctcaactgcaaatacaaaaattagcccggtgtggttgtgcacacctgtaaccccagctactcagcaggttggggcaggagaatcacttgaacctgggaggcggaggttgcagtgaggtgagatcacaccattgcacttcagcctgggcaacaacagtgaaactgtctaaaaataaataaataaataaataaaaataaaaggccgggcatggtggctcacacctgtaatcccagcaccttgggaggctgatgcaggcagctcacctgtgatcaggagttggagaccagcctggccaacatggtgaagcctcgtctctacaaaaatacaaaaattagtcaggcatagtgtcacacgcctgtggtcccagctactcaagggactgaggcaggaaaattgcttggactcaggaggaggcagaggtgcagtgagtcaagatcgagtcactgcactccagcctgggcgaaagagcaagactccgtctccatataaaaaaaaaaaagaatgaagtcgaaacacatctaatagtagccttataagagaagaatatagtcattaaaaaggagagtgtacttaaacaagtaatgagtgagaatttctcagatttagacaaatgtcttaagatttaaagggatcttcgtacacacacacatacacacacacaggaacagtgaaatgaaaaattgtgaaagacaaagaaaaaatattttttaaatgatctgagagaaacagcaggttacttacaaaggaaaaatatttaaaccttcatcaggcctctcaaacaccacactggaggcaaggatacaatagtgtaataactccaaactgttgaacgaaaggaatttgttttcttttttttttgagacagagtctagctttgtcacccaggctcaagtgcagtggcatgatctcggctcactgtaacctctgcctcccagtttcaagcgattctcctcagcctcctgagtagctggggctacaggcacacaccaccacacctggctaatttttgtacttttagtgcaaagttagtagagatggggtttcgccatgttggccaggctgatctcgaactcctgacctgaggtgatctgcctgccttggcctcccaatgtgctgggattataggggtaagccactgcacccagcgaaagaaaggaatttttatatttggtggagtaaggcaatgtcaggcatataacacttcaggagatcgaagacacagggaaatgttaaagcaaacaagtatttattgcaattgttaaagacggtaaggaagggccatctgcagtggctcatgcctgtaatcccagcactttgggaatccaaggcaagagggttcgttgagcccaggaattcaagaccagcctgggcaacatggcgaaaccccgtctctacaaaaaaatacaaaaattagacaggcacatcaagttcctgggtctgtagagaattttttttaaaaatagctggatttggtagtgtgtacctatagtcccagctacttgggaggctgggacaggaagattgcttgagccctggagtttgaggctgcagtgagctaggattgtgtcactgcactccagcctgagagacagagtgagactttgtctctgaaaataaaaaaaaaagatcgtaaggacgactttactcagagcgggaactactgtgataggcacagggacaactgcaatggggtcttgcggtgggagagtgatattgggatcgacttcaactccaccaaggacaagtggggatttgtagtcagggagtaggagccgggggtcagaagatgggaaattacttggaggaaatctcaggtgtgcagggggattctggataaactgatttgacaggattttggtgaaacaggctaaatgggcagagtccctggatgaaggacagagcccgaggttgggacctagtcagaaacaggactcagaggagcctgactcaagtttggtcaaaggagagtgtctctgtgtgaaagcataagcaagaaagtcaacagaagtaaaatgaatggatcacaaaggagaatttttgtgcattgctaagcaggactctgctttaaccattgtgaaagtttattatgtgaagtgagtcattcttagttgttttttaagttcttatttgcagaggaagccttcaggtactatgcttcagagagaacaggttgtaactttttgtttgtttggtgttttttgagacagagtcactatgttgccaggctagagtgcagtggctccttctccgctcactgcagcctccggctcccgggttcaagcaattctcctgactgagcctcccgagtagctgagactacaggcccatgccaccatgccgggctacttttttgcatttttagtagagaccggatttcactgtgttagccaggatggtgtggatctcctgacctcgtgatccgcaagtcctggtgatccaacaagtctgtgttgatgttgatgccagagagatataatgaggcattcctgacctacacttcctgtcatggcctgaaaccgtctctcaggttaaattttaaaagagccctggcttaggaggacatccattcagatggtggggggcagggggcttaggattttatttttgatttataagtcttataagataaaagtgcataaattttaaggaacaagtctcgtgcctgatgtatggaccacacaaaaagttcaccaaactatccaatgccataaccagagacattccaaagacaaatcagggtgaggagatgatatttccacactgtagacagattttccgaagacatcagaataagtcttcatatcataatgagactcttatccccttaatgtctacatttttcccttgacagaacctaacccccaaatcctttccttcacctagtggtcccttttatagagttggcactctgctttaattcaacccagtcctaaaatgctactcaaagactacaagaggtctcattcacttcccccatagtcttttaatttgtttagctggtgtttacctcagtcttgggatcttggtt[139 bp omitted]caacatggtgaaaccctgtctctactgaaaatacaaaaattagccaggcatggttgtaagcaaatgtaatcccagctactcgggaggctgaggcaggagaatctcttgaactcaggagatggaggttgcattgagccgggatcacgccactgcacttcagcctgggagacaaagcaagaatccatcaaaataaaataaaataaaacaattgctacttattttgatattatgatctttgagctccattcttgttgcctgtctaatatttgttaagccagttctcctaacaggataatgttagcccagtgagtcaagatgattgctaatacagatgggactaataacatggaacttgatgctgaactccaggcaaacctggcatggagtgacaatgaagcctcactttaagatggttgatcagtgaggttttgaaagaaaggtgttgttgaaaagagggaatgtgaaagctgattgtgcaaatgaaccagcttctccagtgccaatgcgactcatttcaaaacaatatgtaacacttttctttctaataaaacttccagcttctctgtgttcgttggacatactgaagaccaccccagtccttgtatatgccctggattgcaattttgtgattcccaaatacagcatttgatttaggatttgtctctataatttattttgactttaacacaattaaccagtatgatgtgtttaaaggtcgccccgtcccctgacaaggtgagtattatactgaatttaaaaattcattctagaacaggcatggtggctcatgtctgtaatcctaacactttgggaggccgaggtgggtggatcacctggggtgaggagttcaaaaccagcctggctaaaatggtgaaaccccatatctacaaaaaatacaaaattagctgggcctggtggcgcatgcctgtaatcccagctacttgggaggctgagacaggagaatcgcttgaactcaggagacagaggttgcagtgagccgacatcgcaccgttgcactccagcctgggcaacaagagagaaactctgtcccgaaaaaaaaaaagcattctattataatcttgataattgctttgctgtgcattttactatggacttgttggatatttaggtggctgtaaactatgcagagaaagttagaaacagcagtggagataattagaaaattgtagtgttactataaaagaataagaaaagggggaaattgtaagggtaacgaaacataaaattgaatttttcctgttgcctaaagggaagaagaaacctttctccatttcaccttccttagagcatttccttgagaaaatttgtatttgtaaattcttcctttgatctgtaagcctctgtccaccctataacccaggaatgtcttgaacttgaactccaggcctcaagtgatcctccagcctcagcctcccaaagtgttgggattacaggcatgagccaccacgcccagtccctagaaatgtctttcttcaaggccttggagccatctctttgaaatgtgaacatcgaggaagatgatttccttgtttccctgtcaccaggggagtttagcctaggtgacttgctccaaactgtaagcacctgcttgtcatagagatatgagttttatttttccttcagataagggcagttaactagcacagatgggtactccaaatacttggtgaacttaggacttgcctgggaatatttagttttcatccttggctgttgctgtacaaccaggccagttagccacacacctgaaatttctggtttctgctacgactttttattgtttgtttggctttttcttgtttgtttgtttttgagagggagtctccctctgttgcccaggctggagtgcattggtgcaatcccagctcattgcaacctctgccccccagggtccagcgattctccttcctcagcctcccgagtagctgggattacatgtatgtaccatcatgcccaactaatttctgtatttttagtagagacggggtttcaccatgctggccaggatggtctcgaactcctgacctcataatccgcctgtcttggcctcccacagtgctgggattacaggtgtgagccaccacgcctggcctctgctaacacttttggattgtatgaaacactacacttccaagtgtgggatctggcttcctagacagctgtcaaaggggcagttgatgcaatctagaagtgtaggggagttcgcacctgtggggtaaattttgaccaataagaaaaggaaccaggagtgagagtcaggaacgtaattccctctcctctcctctccccatgcaccattccaggaggcattgtttctcagtatagtctgtctagaggtgtcctgtatggcccaaattctgtttccttgggaacctgagctaaaacaatgggcatgcaaacactcgaagagagtgctaagtgttgtggaggacccagatctgggcagaggaaaattatcccaataagaaaatggacaatttgaggatgtggaatagagggaaggactagaagaaccagtagtagtatagcttaggggtactatttttggagaaaaaggcagttctggtgattgttccagtgaattgctcagctctgttatatatatatatatatatatatatatatatatatatatatcctttctttccatcattttcccctatgaaatcatccataaagtatccttttataactatctgttgcctgtgaagtgaattttctttttttctttatcttttttatttagagatagagtctctgtcgcccgggctggagtgcagtggtgcgatctcgactcactgcaatctccgcctcccgagttcaaatgatcctcccgcctcagctgccctagtagctgggactacaggcgcgcaccaccaatgcccagctaattttttaattttattgtatctttagtacagaagggggttc[140 bp omitted]aaatgcaggggaagctgcacccagacaggtaacaaaacattatatatatatagataggttttctacataccaatattaaccatttagaaaaccaaattgagaaaaaatacacttatatagtgacaaatatacataaaatatctaaaaccagatgattggagcaagatggcagatagatcccatgccccactcaacattccattgaactgggatgaaaatgttttcaagggtcaatccttaacagtagaggaaaataggaaaacgtgccagtggtccaccagaaatattgaggcattcctgggagatagagtagatgggatcagactgatagagaaacccaaggagacaagaccacagctcaaatcactgtaggcgagagatgctgtttgagacagagacttactctgtcgcccaggctggagtgcagtggcgtgatctcggctcactgcacactctatctcccaggttcaagggattctcctgcttcactccccactgtatctggaattcacaggagcctgccaccaccgccagctgatttttgtatttttagtagagatgggggtttcaccctgttggccaggctggtctccaactcctgacctcaagtgatctgcctgcctcggcctcccaaagggctgatattacagagtgggtcaccgcgcctgcccaggagacgctctttgtaacaaagcctctgaaaatccccaaaccctaaatcaaaaaaacacggagctggaaagggccttaggataatcatcaggtaggttaatttaaaagttcgttagaaacgtctgaatcagccagattccgctccaacaccacactcagattggctggcagtagccacttttgtctctaagatgaaactctgataattgttcattaaagaaagtgaaggcctggcgaggtggctcacacttgtcatcccagcactttgggaggctgaggcaggaggattgcctgaggccagtgtatccagaccagcctgggcaacatagtggatgccgtctctataaaaaaatacaaaaactagctgggtgtggtggcgtgtgcctgtagtcccagctagatcagaagctgaagtgggagaatcccttgagcctgggagatccgggctgcagtgagctgtgcttgcatcactgcgttccagcctcggcgacagactgcgattctgtctcaaaaaaaaaagtaatgtatcaggacttggtgtaacttcagccctttacagtaataaacaaggagggaaacacatttgtggagaggggaccatgttcactctttatccatgatagacagatagtccggagctttatatacccatggaacctaaggaaaaatgttccctttcatgactcacaatcttccagccacccttccttgtatctgtcttgtgggctccgggaaccaccttatggatcccatcatcccagggagaaagaaaaatcaaatccttcattatctcttttggggtatgcgctcctctagttgcatggagtttaaggcactcaatatctaatagctgaatgttacatttgtgtaatacagaactatattgggataaaacagaatttgtttcctctgagacacaggtagaggcaggtccacactgacctgggtggcagccacctcttcctgaagtgccaggcagggcatgctcacagatctggggaacctcttgctcctggagccccacaacctccttcctggcaccctctccctctggtggctgtgacagcccacacttggccttgggtatcccctgcttctttgcctgcccttcttctgcccaggctgcacatctctgtctcccactgtccccactatgtccacgattgcctcttcctccctgcactctccatctctaagggctccttgtcttggaaaatgaacccacagcctctaccttgtgactggggacagaacccggagtttgttcaattctccctccctccaccacacacacctgtcctccttaatgtttctgaagtcagtgagctccaaactcagctcctcctgcacctgccagctgtaggacctgtgacaagacgcctgccatctctctgggactccgtctctcatctgtcttataggcataatgatcatagtgtcctccttctaaggctgggtagaaccaggaggccaaggtgatgggccaccaaccggcaaaacagctccaatcctgcctccatctggggctggtgtttcaagtccatggtgtgtgaatggagctttgatgtctccattcacacacaatgctttgtgctaaaatagactcccctctgcccttcccttccccacaactgtttcacctctgcaccatgcaatggtacatgtgagaaagaactgtcccattcccaaatcatcgtccccaccccagcccccaggcccttgggtggtgagacccttgatgggcgctctcatgcttctgtccaggagactttcccaccagttgctcccctgcatggagactaagtggactcctctatttcctgtccatcacagggtctacagtgcacgcatctgcctgattcctccactttcctcagatgacaatttcatctgtgtctcctcccacatccacccaaatggacccttccagaccttgaaacctaaaatttttcagagagaaaaggccaagatgcccaaccacctgctgcagaatcctgctccaggactgaagtgtatagtctgtatcaaaataaaaactggaggccaggtgctgcggctcaggcctgtaatcccaacactttaggagaccaaggtgggaggatcgctttggcacaggaggttaacaccagcctgggtaacatagagagattttcttgacaaaaccttaaaaaaattagtgggtcatgatggtgcattcctgtagtcacagcttctctggaggctgaggtgggaggatcacttgagcccacgagttcaaggctgcattgagctatgatcatgccactgcactctagcctgggaagtgcaagatcgcttctctagcaaaaataaacaaacaaagaaacccaacaactggaaacatcctcctctggaatgggggtcaggaacatctgtctgccttgttccttgatgtctctccagcacctagaacaacgtccagcatgagaacacactcattagtgttttgttgaataaatgactcctttgacacagcaattcaacttctaagaatctttcctaaagaaatattcacacacgtgcagagacctgtgcgcacattaatgagaggagcaaacaactggggaacgtttgcaaaggtgtattaactgtcagtgactgatacggggaatcagaggaggggagtacatgctgaacaggaaacagagtgaggggggcttgaccaggacgcatggcaatggggaaaagcagatgggagatgcttatactggtacttggtgtgtgtgtgtgtctctgtgtgtgtgtgtgtgtgtgtgtgtaaatgcagaggagaaaatcggaaattaaacactcagaactgccctcagtagtcacatgtggggagagaggaaggtagtgctgttctatggagagaatacctgactatacttgttttctgaggtaggtgcatggatacacaaaccgaaatacacattaagcatgtcttgctcatcaatgaaaacattaatatctaacagaattgcacactataagaaaatacaacggaaacactaacatcgaactcttggcacactaaaaaatgaagctcaacttttcactgttgtgaacacttgctttcacttgctatgcacctgatgacgaggggtccgcagccatgcccacgttcgtgaaaggtcaccacattctgcttctcatcatgggcatgtgtcgtatccccgaggctgaggcaagaagagagaaggaaagtaagtggcagtgagttcccaccacgtgacaactcaatctcaactcctcctgacctgcagaccttgcacactctgattctgtcctacctcaggacctgtacacgccttccacggttcctcgaagtgaaccatctgctcatgccacagtgacttcttcgcctgggttatccattcctaggctagaggaaggtgtggcccacatacagggctgacctggagtttggaaacacacagcatcctgggtagggagcatccctggatatacagggcagggagtaaaaagagcttgcgaagaccaggcgcggtggctcacgcctgtaatcccagaactttgggaggccgaggcgggtggatcacaaggtcaggagaccgagaccatcctggctaacacggtgaaaccccgtctctaccaaaaacacaaaaaaaattacccgggcgtggtggcgggcgcttgtagtcccagctactggagaggctgaggcaggagaatggcatgaacccgtgaggcggagcttgcagtaagcggagatcatgctgctgtactgcagcctgggccacaaagggagaatccgtcaaaaaaaaaaaaaaaaaacgtgggaaatctctcatcattcggcctcaatgctgtaccctagaaaattatgagaagggaatgatttggggaacaagtgacagatgggataccagtaccataacagaataccacatctgcagggatgtgggggatgagccgaaggttcacttacggagttactcgtcgtcttcttcagggtcgctgatctcttcataaatcaccagctgctttctctcacgcagtctgtgggtccaggcatgtttcccccttttgggtcctgtgatggagaatagttggaaagtgagggttgggtaggttggagagtgttaggctctgttttctcaaaaaaaggagatgcctcccccctcccaagtgcccatgggccttctttatccagtttttcacattctctggcttagagaggctgagaccttagacccacaccaatacaggccaaatgccaattaaagttttagcttctggctgcttctgttgtggggtttagattcccaacctcttcacttacgggaacatccacccttacctcctttcattcagcacgtgtttttattgagggcaccgaggcatacttttttttatcgcacaacattttcatagtgcttcacagatgctgcaatgttttttttggaaactctcatcaattttacacttttccattattattatatctgttatagtgatctgtgatcagtgagctttgatattattactgcaattgtttttgttgtttttcaggcttttaaaataattttaagttttaaatttttaatttttattttattttattttatttgagacgaagtctcgctctgtcacccagactggagtgcagtggagcaatctcagctcactgcaacctctgcctctccagttcaagcaattctcctgcctcagcctcccaagtagctgggactacaggagcatgtcaccacgcctggctaatattttctatttttagtagagacagggtttcactg[136 bp omitted]cttatggggtacgtgagatgttttgatacacgcatgctatgcgtaataatcacatcatggaaaatagggtatccatcccctcaaccatttatccttgtgttacaaacaatccaattacactcttctagttttttaaaaatgtacaattattattgacaataatcaccctgttctgtgtaattgtttggggggtgggtaccatgaactgcacccatagaagttgacaaacttaatcgaccaatgttgtgtgtgtcctgactgctccaccgatgagctgttccacgtctctcctccttttcttgggcctccctatttcctgagacacagcaacactgaaatgaggattattaacaaccttacaatggccgttaagtgttcaaatgaaaggaagagtcgcatgcctctcactctaaatcacaagctagaaatggctaagcttagtgaggaagcatgctgaaagccaagacaggctgaaagctcggcctcttgcaccaaacagccaagctgtgaatgcaaaggaaaagttcttgaaggaaataatagtatataatgcaaagggaaagtccttgaaggaaataataatattaacactccagtgaacacacgaataagaaagcaaaactgccttactgctcaaatagagaaagtttgagcggtcaggatatttgacgaaaccagccacaacattcccttaagccaaagtctaattcacagagagacccgaactctcttccagtccatgaaagctgagagaggtgaagaagctgcaggagaaacgtgtgaagctagcagaggttggttcatgaggtttaaggaaagaagccatctccataacttaaaagtgcaaggcgaagcaggaaaccccgatggagaagctgcagcaagttatccagaagatctagctaagatcactgttgaaggtggctacaccaagcaacagattttcaatgtagataaaatagccttctatcggaaggagatgccttctaggactttcatagctagagagaattgactcgaactttgaaagaattctactgtgggtaaaatgctatccaatagcatcacacactacagagaaatccttcatgaaatggagagctaatcgatgtggcaaatttcactgttgtgttcttttaagaaactgccacagccactccaaccttcagcaaccaccaccttgatcagccaacagccatcaacaccgaggcaagaccctccaccagcaaaaagagtgagtcactgaagactcagaagattattagcatttttaacaatgaattattttaaaataaaggtatgtacatttttagacataacgctactgcactcctagtagactgcagtatagtgtaaacataatgtttttatgcactgccaaaccaaaaaaacaatgtgtgtgactcacattattgcagtggtctgggactgaatctgcaatatctctgaagtacacctgtactgggtatcaggcattgagctaagtaagatatgatcccaggttatcaaagatagaatcgcttgagcacctttcatatcatcaggccttctagattaaatataatacttccaaacaatttatgaactatgattctttatttccatcttatggactaggaatctggaactgagaaaatttggaagacttgccccaagtcacgtgtttttttatatggatgacaactccagtctgtatctctggaagtccagtcaaacatctcatctggagctgggtgagctcctcagcccagtctgcacccaggcttgtctgggatccatgccacacacccagtccacacacctgaacatagccagggaagccagaggggttgttcccaaattatttcctcttcccagatgccttgttaatcttctcagaggtagttggttttcccggggggcacagctgtttcccatcgttctgtaagccagatgcttctggcacttccttcgaatcatttcctacctctgctggcttcttgggcatgatctttataatgtgaaggtcacagataaacagtatcggtgacatttctacagtgctttagagcttacaaagggtcttcacatgcattactttaatcaatgttctcaacaatgctgggagagttacacttgcctaaattaggagaaacctgggaggttagatgggaaaggaatggcctatgtgaatatggtttccagggctagaatgcttatcttcacactcttttaagactgacattcttgcaaacagcaaaaatctccatgtaattgagagtttggtatacaaaagattggaaggaggatagcattctaagaattcataaggtctacaaaaggaagagcttctgtaaaatacaagggatctcatattagctcttagctgctgggagagtaaatgtaaaaacatagagaggggacaaaacactgctgggaaagatgttgtggggagatgaatacagggacaggagaggtaaagaaatggtttgctgaaattaatctaggcagcaaagaaagcagaggcaccaattgaatgtggaattcagtgaggtggtacccataccaattctggttgcattgggacgtgtcactgaccaacaatcttaagctactttttttttttttttttttgagacacagtcttgctctcttgccaggctggagtgcactggcgccatcttggctcactgcaacatccaactcctgcgttcaagtgattctccttcctcagcctccagagtagctgggactacaggcaggttctaccacgccccgctaagttttgtatttttagtagagacgaggtttcaccatgttgggcaggatggtgttgatctcttgacctagtgatccatccaccccagcctcccaaagtgctgagattacagtcgcgagccaccgtgccccgctcttaatctactttttattcagcttcctcacttatgaaatagtgaacaatacacataaaatagtctatgggaaagtcctctctgagcttgtaaacactgtttaaatgtagtaataataacaattaatacctttcatgatccatctttgaattcggtctccacactggcaacccaactcccagatccctttatcctctaaaccagagttggatctgcagttgtgggatgactcattcaggggtctttgagggaacccctgggctggaatgggggcttccgggacgccccaggtgcagacaaggtcctcaaggagctcacagtagggaggggccaacagtcaaagcgattcctaagccatgcaagtggtcccagtaacagagcagaggccagctggtccttcctgttgcgagagcgggtgtctcaatggaagcaccaggaggccctatggggtaaagccctagtgagcaacatctgaacttcataaacaaatgcaaacgtgaatgagctttaaatggcttggagctctggattagactaccactgacactgtgccccaggaaaattctttaacatctctgtacaatgatagcctcattttattattatgttgctgataactatgatctaaaacatgaactatgattctttacttccatttcatggaccaggaatctggagctcagagaactcagaagatttgtgccaagtcacatggcttttatatggatgacaaccgaagtgtgtgactcgttattatttggagataataatagaaacaacatcatagaggtcttcttaaggattaaataaattcatccatgtgaactgcttaaaatagtatctggcatcactatgaaaacaaaagatgtattgaggatcacaactgttagtgttatcaagctgttggtgctacatcaggtgttgtgatagatatggggagaagaaggcagtgagggcattttttatattctcccactcttaccagtgttcccatctgtggagggacaaaggttctctggtcctttagatttgagagatactcaccttcgggaagattccctggagcctgccgaaagtcatctgagaacgttcaactgcaagagaatacatcagaatttttccttgttggtaaagatttccaaactctatagagacttctgtagcatcagggtattctccagcagaggcttatgagtccactcattgttgaggagttatttcagatttgcttctgaattatgtttagtaatggttgattcatttatctgtggcatccattcagaattttccatctcatagtttatcaaatgtggactaaaccccatcacagtctcatcttattactttacatatcttttacttttttccaaataattaaattgattggttaagaatctgaactgtatccactcaagatgtgcaataactgaaaatcactgtacacttaaaatgggtgaatcttacggtatgtgaattaagctgttaaatgtgtgatgaaccatggatgatttggtccagtggctctgaaatattttcagtataaagacacttctttaatgtcaaaatcttggcagacactcaagccctggattttcagatctcttgtagtgatcgtgggagattgtagaatctggcctttttagttggggagtaataggtctattggagatagtttggacattctgaccttgtcttataattgtgttgtcagagcagaagagcaaggaaacacatatgccccctttatattactgaaatgtacaaagatctctacccaagaacctgtctttttttcaccctgtgttatctctgctctctgacaagtgggaaagctctctgtgtgtgggatgagggatcactctttcaaactcactcccgagctcatcacagagaatcagggttctttgggaatgagaagactatttggttttgataaaatacagagaaacagcgatctttattacataatgtgttcatcaacctcactcctaagatacctatccaatacctacatgctgttaatgaaacaaactctggaagtttttggcagatctacactagtaacattttctttctttttttttctcttgtaacattattttaacagtcctttgattcattaacagtgcttaggaagaacaacatgtcgtttaaaaaagaaatatttcaaacacacagaaaagtatggggaataatattgagtccagtcggatctcaacattaccccacagctatgttaggtctgatttatttattcagaatattagaaaaactacaaacaggccgggcgtggtagctcacacttgtaatcccagcactttgggaggctgaggtgggtggatcacctgaggtcaggaagtttgagaccagcctggccaacatggtaaaaccccgtctctaccaaaaataaaaaatgagctgggtgtgggggcgggcaactgtaaccccagctactccggaggctgaggcaggagaatcacttgaacccgggagttgaaagttggagtgagctgagattgccttattgcactccaccctggccgagaagagtgaaactccatctcaaaaacaaaaacaaacaaaacacactatcaacaagtcacagctgaacctgtctgtgcagcactcagcaatccctgccctccctccctcctccacttacagccagtcacctcaatttgatggctttttattcacattcatgtttgtatacatttaccatttacttattatctataaaaatatatatacttgtttttcatgttttaaaatgttacatgaatggcctctgtcgttaactttctgcatgcaattttttttcactcagccctgatgtgtatgagggaacaaatgcctgaggatctttcccaggtaactgagctgaaaagcaattgggcttgatgagaccctttccagccccttcccatctactcaccctgattcctgtggttacggtcattatcaaaatcattcccctggaggtctgtggcccctgtattacacatgaaaggtgggagggtagccttgaaacctagaaagaagcaaaatgtttattcctaagagacaagctttgacctgccacggtggttcatatctgtagtaccagcgctttgggaggctgaggctggagtattgcttgaggccaggagttcaaggctgcagtgagctatgattgcactactgcactctagcctaggtgacagactgagactctgactcaaaaaaaaagaaaaaaaaagaaagagagatacaagccgagagaaggaaggtagggacggtgtggaggtgccgggatgccacagagacacttggactcatcagaacagaagcctaagggagagaaacgtgcaggatccaggtatgagctccactgtggccagtccctgccctcagccctgacaggatacagaagagcagaacacccagaagctgccttgcgatttttccctgcacaaaaggaaaatgtggggtactttctgcagcctaagaagtagccaaagcaggaaaagggatgctcatgtgtccccagacttgtctgtacctagaactttctgttacctagtttagtcatggcctcatactttctcttcatatacacatagatgattttctccgaggatttcatcttttcccactctttcttagagaagtatttggcaatatcatcgaaggcctaggaaaagataaaaaaggaattttgtcagtgactcagctagacacgtctgccattcagctggagccgcctcctgtgtgctggatctgggaagtggggatgatattccgtcctggttgatgccatggctaactgacagaacatgagggacctttcctagcttcacccctgccacacagtagggctttaatgctgctggctggctctcttcccactttccagaatggactgagattcaccaaatgtagtgcacggtcacagacttgtctccaaggatgctagttgatgatagagcgaggatgggaggctctcaagggtccagatctcccccaagaccctgctccttgtctccagtatctctatcctcccctcctcagaaaccggtcaccccacactgtcccctgggccactactttgccccctccaggtcacctcaccttttggatcttctctggtatttgagaaccagccctaggtctccttgcaaaggcatcgtctccgttcatggcaccgggagcagtctgtcctgcaagagaaacagaccgagtctttccagccacagcagctttggtcttgtggagggagaaatcagtgaaggccggccaccctcagtcacctggaatcaggtgcttcatttctccatctggggcttatctgtccctgagtaatgacatggggcgaagtcagatgaaaatagggaaccaggggtctctgggagaagtattgatttgggatgacaggcttcctgtgggcaaagcagccttgagtctttgggagggggttggctaatgttgttagtagtttccctggggccaggcttaccctgaaagatgtacagacccttgttgggaaggcagagatgtgactgtgtaattttattcagtgggggcatgctgacacccccactcaataaataaaggaagggaaatgagtcccagagataacatggtctctctggtgatggatctgatcaggcagagggatggggggttctgttctgttgaagagaaatgagcatggctaatatgaacggatttagaggctattactgggtgatttgtaaattattagaagaagagagctagaatttctgagactacaagagcccgccatcacttaaagagaatgtagggagtttcaaggtacagcaatcagccaggcgcagtggctcatgcctgtaatcccagcactttgggaggacaaggagggcgggtcgcttgagtccatgagcttgagaccagcctggccaacataccgaaaccatctctactaaaacaacaacaacaacaaaacacacacacacacacacacacacacacacacattaacagaagcggagtggtgtgcgcctgtagtcccaaggcctacgtgagaggatcacttgagcccaggaggaaagatttgagtgagattttttgtttgtttgtttgtttgtttgttttgagtcatggtctctctctgttgcccaggctgggatgcagtggtgtgatcatggctcactgcaacctccgcctcgtgggttcaagtgatccaccagctgtggcctccaaaactggagttacaagcgtgagccaccgtacccggcccaaatttgttaagttactagagttcccaggaaaaatcccatacctgaaaaagttagaaactgacaggaaggatttgagatggcgacctgcctcacatacactccttattaaaactagataacaaatgcaccgcggaggaggggaggggtaggaagaatggaaaaagaaaatcagcgcatgcttactctgattttggaagaatcgaaagagaaaatcagaccgtgcgtactctgagtatggaagaatcgaaagagagagaaagtcagagcatgcatactctgaacttaaagtagccaatcccgggggatgctttaggcgggaaaatcagggtctccacccccagttagaaagttctgtccctggaggctggactgatagacgccacatcagctttgcttatcccgcctactgttctgacttctgattggccagatggagttcaccgactgccctgattggtccatcatccttgcgcagtgacattgcacaatattgtctcctcctccagcaacactttgttgccactgggacaaagtgggtggtcctcaggcgccgtcagattttgaactctctgaagaccatgcctggatctcgggttaaaaatctggattctagtctgaacagcgagaagaaaaaaatagtcggatctgtgatttttctacttgaaagacacaatgttttccagactagcacatttgcagagctttgctgtacttagtcgtggctttcattcttcagtggcttctatatctgttgccactgaaaaaacagtccaaggccctccaaccgctgattacatttttgaaagggaatctaagtgtggtgtgcacaattagcatccttacctgtagccctggagagacgaaaatgtatttacttaacgggatgtgattgtggtattggttacatccgccttggccaatcttcccgcctcggtctcgtgactacaggcgggaaccaccccacccccactcatatttttcgttttttgattttttaaaagagacagtttcgctatgttggtcaggctggtctccacgtcctgggctcaagcgatcctcccgcctcagcctcgggactacaggcatgcaccaccttgcccaggctttttttttttttaagtagaaaccatgtttcgctatgttgaccagactggcctcaacctcctgggctcaagggatccttccaccacagcctcgggacttcaggcatgcaccacccggcccacgctttatttatttatttattttttagtggaaaccaggtttcgctatgttggcctgggctcaagggatcctcccgccttggcctggggactacaagcatgcaccaccctgcccaccctattttttttttttttttttttgcttctttgtttgtttctttctttagtagaaaccgggtttcgctatgttgcccaggctggcctcaatctgctgggctcaaatgatgctttcacctcggcctcaggaatacaggagtgtgccattcttcctgctcattttaattttatttacttatttataggaaagacaggctttcgctttgttggccaggctggtattgacctcctgggctcaagcagtcctcccaccttggcctcggaactacaggggtgagccatcccacccacgcaatttttttgttgttcttgttgttagtagaaatggggtttcgctatgttggccaggctggcctcgacctcccaggctcaagcaatcctcccgcctcagcctggtgactacaggctcacaccaccccaccaccactaatatttttaatttttctagtagagacagttttgctatgttgtcctggctggtccctacctcctgggctcaagcgatgctcccgcttcggccttgggactacaggcatgcaccaccctgccttttgctatttttcccaggctggtcttgaccttctgggctcactcaatgatttgaacctgggaagccgaggttgcattgagctgagatcacaccactgcactccagcttgggcgacagagcaagactgtcaaatagataaatacatccatacatgaaagaaagaagaaagaaaagaaagaaagagaaagaaagaaggaaggaaggaaggaaggaaggaaggaaggaaggaaagaaagaaagaaagaaagaaagaaagaaagaaagaaagaaagaaagaaagaaagaaagaaagaaaccagctgaatctccgtaaaaacagtaagctttgtggtatattaacttaccctcatcccatctcgtgctcccagcttggttctgttcattgctgatgaaatacacataggattggccagaactggtagatggctagctattgatcatgaaaatgtcagacctgatatagtcctccttggaaaggccttttctgagggctgatactctgtgtctgcagtgctgtgggacgatgacataatgctgagcattaagccaggcgaccatgggtccacatacggtggcaatccactaggctgctgagtggccatcgcagcccttgaggttttagaagaaaatcttgctgaaaatacagaacaaaatgggtattctcttgagaaatgaacccatgaagctaccttctgatgctgtaactgctgtaagaggaagagaattattgtgtgtatgtgtgtatgtatgtatgtatttagagtcagaggttcactctggttgcccaggatgcaatggtgcgatcttggctcactgcaacctctgcctgctgggttctagcgattctcctgcctcagcctcctgagtagctgggattacaggcacgtgccactatgcccagctaattttcatatttttagtagagactgggtttcaccatgttggctacgctggtcttgaactcctgacctcaggtgatgcacccacctcggcctcccaaaatgttgggattacagacgtgagccactgtgcccgggaggaaaataattattaatttctattgttattaaagaaaccaaagattgtgatgcttggaaggtgtgtctacgacttcaagattatccacttctggccaagccaacccatggcgacatcatcaggtttcgcctccgctggtggtgaagggggatgagattcaagtccagtgaaatcattaacaaggccatcttgtcgttctgagggtagcagctgttttcagtggtccccaggagccggctggagacaggtggtcttgtaaaagctctgcttttaatgcaggcacattccactccgtgtgtcttcaaaacctttttgtggagtatctatttttttcagttaatacatagtagaacaacatttatgaagctgctgtttgctttgtaacgtaagtaagagcatgcaatggcatctatgttctgtgaaagtgttttgatgtgttgtgtactttctaaggttaaacgtatctatatatacagacagcgtttaaattacatcattcagtgtactttatatatgtttttataatttccttgctggtataaatgctttgtatttgaaaaagttttctctagggaattacataaaagacttcaccttataaagtcaaatcattgttatcattaaattttaggaaggatgaatggttaagcatgtataaaatactaatattaagtaaacttcatgttggccaacaccaggatgtattctatggatgtcattattttcaattaagaattagtgtttaacattcctaaattgttttgagtgcttgattataatttgtttaaaaatgtttaatatttctttaaatttaacataaagcttgtatttcagaaaaaaaaaaagatacagaacatgcctgggtgcagtggttcacgcttgtaatcccagcactttgggagggcgaggtgggcagattacttgagatcaggagttcaagaccagcctggccaacatggagaaccctgtctctactaaagatacaaaaattagccgggcatggtggcacacgcctgtattcccagctacatgggtggctgagacaggagaatctcttgaacccgggaggcagaggttgcagtgagccaagatcatgccactgtactacagcctaggtgacagagtgagaatccctctcagaaaaaaagaaaaaggtacagaacatttccatcatcataatgctattccttgtgctagtcatttttagtaatactcactctcatcccatccaccatccctaacccctggcaaccactaatctgtttttcatttctataattttctcttttctacaatgctgtacaaatgaaatcttatagtatataacgttttagggacttatttcactcagcataattccctggagattcatccaagatattgatatttgtgtatcaatagttcattgttgttgttgttgttgagacggagtctcactctgtcgcccaggctggagtgcagtgtctcggctcactgcaacctctgccacccaggttcaagcagttttctagcttcagcctcccaagtagctgtgactacaggtgcgtgccaccacgcccgggtaatttttgtattagtagcagagatggggtttcaacatattggcaaggctggtcttgaactcctgacgtcatgatccacccgcctcagcctcccaaagtgctggggtaacagggtgagacactgtgccaagccagtagttcatttttattactgagtagtattccataggatagatgtcccacagtttgaccattcacttattgtaggacatattgattatttccagctactggctattacaagtaaagctgctatgaacaattatgtacaagtttctggatggacatacattttaatttctctgaagtgtaattgttgaattgtatggtcattgcatgtttagttttataagaaactaccaaactgctttccagagtggctgtaagattttaccttcccagcagcacttaatgaggtgtccagtttctctgcatcctcatcaccatttggtgttgtcactatgtcttttattttagctattgtaataagtgtgtagtgatgcctcatcgtggtgttattctgcatctagtgaagcaaatgagtgttgaacatcttttcatgtgcttatttgcttatttcctcttcagtgaaatgtatgctcatatcttttcataattttctaattggattatttgggtttttttttttacctttgagttattattattattattattattattttttaaggcagagtctctctctgttacccaggctggagtgcagtggcatgatcttggctcactccaacctccgccttccaggttcaagcgattctcgtgcctcagcctcccgagtagctgggattacaggcacgcatcatcatgcctgtctaatttttgtatttcagtagagatgtgttttttgccatgttgcccaggctggtcttgaactcctggcctcaagggatctgccctccgtcgacctcgacctttcaaagtgctaggattacaagtgtgagccaccaaactcagcctaccgttgagttttgagagtagtatacatatccattatatattctggatgtgagtcctttcttggatatgtggtttgcaaacattctctcccagatcataccctgttttttcatccttttaacaagatttcttgcagagcacaagttttaaattggatgaaatctaatttatttttttccttattgattatgctttttggaccattcactgtgccctagatctcagacgtttctcctatattttcttgtaaaagttttcttttagttttatagtttagatttaaatctgtgatgcacttgagttacttttttgtataaaggtaagaaaattaggtcatttttttttggcctatgtctacaacatctccagcaccatttgttaagcagacaatccttccttctttttgtctcttggtaaaaaatcagtgtggggctatttctaggttctctattttgttccagtgatctatgtgtctactcttctcccagtactacacagtcttaattcctgtagctatataagaagtattgaaatatgaaagagccattcctcccatcttattcttctttttcaaaaattgtcttagctatataaatattttttgagatggagtctcacttgtgtcgcccaagctggagatcagtggggtgatcttggctcactgcagcctccacctcccatgttcaagtgattctcctgcctcagcgccccgagtagctgggatttcaggcactcaccaccacacccagctaatttttgtatttttagtagagatggtgttttgtcatgttggccaggctggtctcgaacttacctgaagcgatccgcccatctccgccttccaaagtgctgggattacaggcgtgagacaccactcccagcattgtcttagctattgacaatttgttacagcaacaatcaaaaatgaatatacttagaaacagattagtgtaacaaaatagaaagtcaagaaacagactaatttatataccaacttcagcatgcatttccaaacaaacagtgggcaaaagatgggttgtataataaaggattgttgacaagtgtctatccatttgaaaaaataaagatgaaatccttatgctgaaccacataaaataataaattctaaaagttcggagacataaatgtgaaaacgtgaagtcataaagaactagatgaaaattcaggaaaatattatagtgtaagagatcttgaattggcataagcaaatcctgacattacaccaaggatataaacaattaatctgacatagttaaagatgtaaaaattaaagtatcatctaagtcaaaagacaccataaacaactgtttaaaaaggcaaattttaggctgggcgaggtggctcacgcctgtaatcccagcactttagggggctgaggagggcggatcacgaggtcaggagatcaacaccatcctggctaccatgatgaaacctcgtctctaataaaaatacaaaaaattagccaggcctggtagcacatgcctgtagtctcagctactcgggaacctgaggcaggagaatcacttgaacacgggaggcagaggttgtaaatttaagaggaagcagaagatttcaataagcaatggtgaggagaaaaatactagaatttattgaaaagtgtaaagtttagattgtaaattaaaaaaattatagtcttgaactaaatttgcaggtattataaacatggaagatgggaggagggacagaaaagaaaagagaagttcttttggtgttcaacgaatggatacagatactaatgaatgatagaatggtagaatggttaaaaacacgagcattttattttgttttattttagacagggcctcgctctgatgcccaggctagagttccttagcacaatcgtggctcactgcagccccagcctcctctgctcaagtgatcctcctgcctcagcctcccatgtagctggggcttcaggtatgaaccaccacccctggctaattaattttttttggtagagacagggtcttgctatgttgcccaggctgaccttgaactcttgtcctcaagtaatcctcccacctctacctctcaaagtggtgggattacaggagtgagtcactatgcccagttaatgctagtattttagagtacaaactctggagccagacagcttgggtgcagtttctggcttctcaacttattaagctatgtgaccttgtgtaagtcatataacctttctgtgtctcaggctactcaagagtaaactggggatagccacactatctagctcatttgattgctatgattaaatgggtaagtacgtgtaaagcacttagaatagcgcctgtcatgtggttaagttagtatatatcttttagttgttgttagtaatgacttcaaattacttttaaaatgtaaaagcatatctggttcaagaagaagatggtgaaccagcaatagctgctggcttccttcccaaacccaaccctgcagatgccacagaagaggtgggaagtggttggagttcagaacagttcctgtaacaaaacccttgatggtttggccccactgggggatgagacggcttagagtgggaaaaggtcagaggccacagatggaggatcagcccaggtggagctttctaagttgcattcttgttttctccttgttttctggatggctcattacctgttgtgtaaacatataaagcagacacttggcagggctggcctagtgctagcccaaagtggcgtgataacattaaggaatagggggcttggaaagctcctaaaaaaaagtgcagactcatcaaagctggccagtaactgaacattcctttcctacctctccctctgccctctgagctaggcaattacaaccaatatcacccacccgtagactccctccactctgtaaggcagaaatcctgtaagtgtctctgggggctaataggctaggaactggaaagaattggctcagctcagctcagctctagaggctgtgtatcctatgacctatcaatccagaaaccctgaaactcacatgtagtgtctggggtgacacatttttcccagggacaaagagttatatagaaaaactatcagataggtcaggcgcggtggctcatgcctgtaatctcagcactttggaaggccaaggtggggggataacctgaggtcaggagttcgagaacagcctggccaacacggtgaaactctgtctcttccaaaagtacaaaaattagcccggtgtggtggtgtgcaacggtagccccagctactcgggaggctgaggcagtagaattgtttgaacccgagagtcggaggttatagtgagccaggattatgccactgcactccagcctgagtgacaaagtgagactctgtctcaaaaaaaaaattcctttctttcaacactttggagttattacaccattgtatccttgcctccagtgtggtgtttgagagacccgatgtcagtttaattatttttcctctgtaagtaacctgctatttctctctgatcgttttaaaactactttttctttctttcacaattttacatttcactgatcctgtgtgtgtgtgtacttacaatacctttaaatcttaagttatttttctaaatctgagaaattctctttcattacttatttaagtacactctcctgtttaatgactgtattctcttcttataaggctactattagatgtgttttgacatttattcttttatcctccctattaattaacttttatttcatttacttcatctgtatccattaccgattagttttatgaattctttagactcatttcctcaggtcagcaattgccttttcaattatatcagttttaatatccaacctatttcactgaattatttatttgagcatttaatgttttcatatccaatctatccaataggttatttatttttttatttatttatgatggagtcttgctctgttgcccaggctggagtacagtggcgtgatcttggctcaatgcaccttgcctcccgagttcaagcaattctcctgcctcagtagataattaaaaaaaaaaaaaagctgcatttggtggtgtgtacctgtagtcccagccactcaggaggctggggcaggaagattgcttgggccctggagtttgaggctgcagtgagctaagattgggtcactgcactctagcctgagtgacaaagtgagactttgtctctgaaaattaaaaaaaaaaagatcgtaggcacgattttactcagaagggggagtactatgagatgtacacgggccactgcaatgggtttttgtggtaggagagatattgggatcgacttggactccaccaaggacaagtggggatttatagtcaagagtagggttggggggagcgggatcagaagatgggaaattacttggaggagacatcaggtgcaggcggattctggctaaacagacttgacaggaattttgctgaaacaggcttaatgggcagagtccctggatggggaggtgtgagccacctcacctgaccaacaggctttgtttaatatgtcagttttcataagtaatctaggtataattgttaaaaatgaataaacgaggtaaatgtgagatacatgtttataaatgaacttttcatataattggaaatctttttttcttgctcttatcatacgaagatgaaatattaaagttgtgttatgttagattaagtaataggtactcactaaatattgggatcatttccaactaagaaaacagctgaaacaaatcgctaaacttaaatacaagtttgttcttggcccttaagttttataaaacacaaaagatatttggatccgttaataaaacgccctgttctacattgaaaattgttctggctggacttggtggctcacccctgtaatcccagcactttagggggcgg[134 bp omitted]caggcaagagaatcgcttgaacttgggagccggaggttgaagtgagcggagaaggagccactgcactctagcctggcgacatagagagactccatctcaaaaaaaaaaaaagttacaacctgttctctctgaagcctagtacctgaaggcttcctctgcaaataagaactcaaaaaaaactaagaacgactcacttcaagtaatcaactttcacaatggttaaagcagagtcctgcttagcaatgcacaaaaattctcctttgtgatccattcattttacttctgttgactttcttgcttatgctttcagacagagtcactgtcctttgaccagacttgagtcgggctcctctgagtcctgtttctgactaggtcccaacctcgggctctgtctttcatccaggaactctgcccatttagcctgtttcagcaaaaatcctgtcaagtcagtttatccagaatccccctgcacctgagttttcctctaagtaatttcccatcttctgacccccggctcctactccctgactacaaatccccacttgtccttggtggagttgaagtcgatcccaatatcactctcccactgcaagaccccattgcggtggtccctatacctatcacagaagtccccgctctgagtaaaatcgtccttacgatctttttttttattttcagagacaaagtctcactctgtaactcaggctagaatgcagtgacccaatcctagctcactgtagcctcaaactccaaggcccaagcaatcttcctgccccagcctcccgagtagctgggactagaggtacgcaccaccaaatccagctatctttttttttaattctctgcagacccaggaacttgatatgcccgtctaatttttgtattttttgtagagaggggattttgccacattgcccaggttggtcttgaattcctgggctcaaccaatcctcttgccttgggctcccaacatgctgggattacaggcatgagccactgcagctggcccttccttacagtctttagtaagtgcaataaatacttgtttgctttaacatttccctgtgtcttcagtctcctgaagtgttatatgcctgacattgccgtactccaccaaatatagaaattcccttctttcgctgggtgcagtggcttacacctataatcccagcatattgggaggccaaggtgggcagatcacctcaggtcaggagttcgagatcagcctggccaacatggtgaaaccccttctctactaaaactacaaaaattagccgggtgtggtggtgtgtgcctgtagccccagctactcagaaggctgaggaggataatcgcttgtaactgggaggcagatcatgccactgcactccagcctgagtgacaaagcaagactctgtctcaaaaaaaaaaaaatcctttcgttcaacactttggagttattacactattgtatccttgcctccagtgtggtgtttgagagacccaatgaaggtttaaatatttttcctttgtatgtaacctgctatttctctcagatcatttaaaaaatattttttctttgtctttcacaattttttatttcacagttcctgtgtgtgtatgtgcgtgtgtacgatgacccctttaaatcttaagacatttgtctaaatctgagaaattctcattcattacttttttaagtacactctcctttttaatgactatattctgtttccataaggctactattagatgtgtttcaacatttattcttctatcctccctattaattaactttcctttcatttacttcatctatatccattaccgattacttttatgaattctttagactcacttcctcagctcagtaattgctttttcaactatatccattttaatatccaacctatttcactgaattatttattcgagcaattaatgttttcatatccaatctatccaataggttttctttttatttatttatttgagatggagtcttgttctttcatccaggctggagtgcagtgactccatcttggctcactgcagctctgtctcctgagtccaagcaattctcctgcctcagccccttgagtagctgggaccacaggcgtgtgacactatgccaggtgaattttgcatttttagtagagacggggtttcaccatgttgaccaggctggtctcgaaatcctgacctcaggtgagccgcccgcctcagcctctcaaaatgctgggattacaggtgtgagccactgtgcccggtcttttattttattttattttattttttacagtttcactattgttgcccaggctgaagtgcaatggtgtggtctcacctcactgcaaccttcacctcccaggttcaagtgagtctcctgccccagcctcctgagtagctggggttacaggcatgcaccacgacacacagctaattttagtagagatgaggtttcgccatgttggccaggctggtttcaaactcctgacctcaggttatcctcccgcctctgccttccaaagtagtgggattacaggtgtgagccaccgcgtctggcctatccgatagtttttctatataactcttttttcctgggaaggtgtgtcagcccagacactccacgtgagtttcagggtttctggatcgatagatcgtaggatacggagcctctagagctgagctgagccaattcttcttccagtccctagcctatgagcccccagagacccttacaggatttctgccttatagtgtggagggagtctacaggtggatgatattggttgtaatcgcccagctcagagggcagagggacaggtaggaaaggaatattcagttactggcccgctttgatgagtctgcactttttctaggagcttcccaagccccttattctttaatgttatcaggccactttgggctagcactgggccagccctgccaagtttctgctctgtatgtttacagaacaggtaataagccttctagaaaataaggagaaaaaaagaatgcaacttagaaagctccgcctgggctgatcctccatctgtggcctctgaccttttcccactctaagccatctcatcctccagtggggctaaaccatcaagggttttgttattgggaactgttctgaactccaaccacttcccacctcttctgtggcatctgacatctgcagggttgggtttgggaaggaagccagcagctattgctagttcaccatcttcttcttgaaccagatatgcctttacattttaaaagtaatttgaagtcattactaacaacaactaaaagatatatactaacttaaccacatgacaggcgctattctaagtgctttacatgtatttgcccatttaatcatagcaatcaaatgagctagtgtggttatccccagtttactcttgagtagcctgagacacagaaaggttatatgacttacacaaggtcacatagcttaataagttgagaagccagaaactgcacccaagctgtctggctccagagtttgtactctaaaatactagcgttaagtgggcacagtgactcactcctataatctcaccactttgagaggctgatgtgggaggattgctcgaggtccagagttcaacgtcagcctaggcaacatagcaagaccctgtctctaccaaaaaaaaatttttttttagttacccaggcatggtggtgcacacctgtagtcccagctacatgggaggctgaggcaggagggtcacttgagctgaggaggctggggttgcagtgagccatgattgtgctatggaactctagcctgggcaccagagtgaggccctgtctaaaataaaacaaaatttaatgctagtgccttttaccattctaccgttctatcattcataaacatctgtatacattccctgaacaccgaaataacttctcttttttttcctgtccctcctcccatcttccatgtttataatacctggaattttatttcaagactataattttttaagtttacaatcaaaagtttacactttttaataaattttactggttttcttctcatcattgcttattgaaatcacctccttcctcttaaatttacttttctcttctcatagacctgtataccaataatgatttctgaagggtacatgtgtcatgaattttctgaaatattttttccctcattctggattatcctggctgtatatagatatctaggttcaactttttttgtttgtttttgttttgttttgttttgttttttgagacagtgtctggctctgtcacccaggctggaatgcagtggcaccatctcggctcacagcaatctccacctcccagactcagctgggactataggcacgtggcaccacacctggctacttgttgtattttttgtagagatgggttttgccttgttggccaggctggtctcaatctcctgagctcaagctgtcctcccatcttggcctaccgaagtgctgggactacaggcgtgagccactgtgcctggcccaaagttatttttaatcagctccttgaaaaacatctccattgcattctcttttctctctttctctctggggcctttcaggattttatctttatcctagaaattttactcctagggagtgtgtgtgtatatatgtgtgcgtgtgtgtgtgagcgtgtgtgtgtgtgtgtgtgcgcctgtgtgttaatcaggttcagaactaggtgacttttttcagtttgaagattcatgtgtttgttcagttgagaaaattctagaacattatttcttcaagtaccgccttctctacagtctttctattctttttttttttttttttcctttttgagtcggagttttgctctgtcatccaggctggagtgcagtggcacaatctcagctcactgcaacctctgcctcccgggttcaagtgattctcctgcctcaggcttccacatagttgggatttcaggcgcccaccaccacaccgggctaatttttgtattttcagtagagacggggtttcgccatgttggccagtctggtctcaaactcctgaccttaggtgaggtgcctgcctcagcctccaaagggctgggattacaagcgtgagccacggcacctggtccagtctttctattctctacctctgcaacttctattggatgaacgttgaaacttctgggctctatcctccatttcctttactattttcatttcatactttctatttcataatccttttctcctatacggtgaagtagtgccatgcctgaacacattttttcattgggttgttccagtttctcttactgatatgcaaaatctttgttgtatattagagatggttactgttaatttattgaggatgcttcaccaatttccccaacatttgcctttttaaacagttttgtggtgttttttgaattagatgatactttaatttttacattgttatgtcagattcattgttcatagccttagtgtaatatcaggaagtgcctatgacacctccagatgtcttacactgtaatattttgctaaattttcatctagttctttatgacttcacattttcacgtttaagtaactgattttttagaatttattattttatgtggtttaaagtaaggatttaatctttattttttcaaatagatagatacttgtcaagcaatcatttattatacaacccatcatcttttgcccactgtttgaaaatgcatgctgaaatttgcgtatagattagtctgtttcttgactttctattttgtttcactaataaatgtttctatgtgcattcattttttattgcagctgtaacaaattttcaatagcttagacaacgctaggtacagtggctcaggcctataatcccagcactttttggaaatctttaccaacaaagaaaaattctgatgtattctctttcagttgaatgtcctcagatgactttcagcaaactctagagaatcttcccgaaggtgagtatctctcaaatctaaatggccagagaacctttgtccctccatggatgcgaaaactggtaagagtgggagaatatcaaaaatgccctcactgtctctttttcccatgtctatcacaacacctgatgtagcattgacggcttgataacactgacagttgtaatccttaatacttcttttgttttcatagtgctgccagatattctaagcaggttacatggattaatttatttaatccttaagaatacgtctatgacgttgtttctgttattatctccaaagaataacaagtcacacactttggttgtcatccatataaaagccatgtaacttggcgcaaatcttctaagttctctgagctccagattcctggtccatgaaatggaagtaaagaatcatagtttatgttttagatcatagttatcagcagcataataataaaatgaggctatcattgtacagagatgttaaagagttttcctggggcacagtgtcagtggtagtctaatccagagctccaagccatttaaagctcattcacgtttgcatttgtttatgaagttcagatgttgctcactagggctttaccccatagggcctgctggtgcttccattgagacacccactctcgcaacaggaaggaccagctggcctctgatccgttactagagccactcgcatggcttaggaatcggtttgactgttggcccctccctactgcgagctccttgagggctttgtctatacctggtgcatccaagaagcccccgtcccagcccaggggattccttggaggcccctgaatgagtgactccacaagtacgtattatactccggtttagagggtaaaggaatctgggattgggttgccagtatggaggccaaattcaaagaaggatcatgaaaggtattaattgttattattactatatttaaacagtgtttataagctcagagaggactttcccttagcctattttacatgtattattcactattacataattgaggaagctgaataagtgtggcttaagactgttggtcagtgacccaccccaatgcagcaagaattgatatgggtaccacctcactgaattccacattcaatgttgatgcctcagtagggtggtatgccagatctggtactgctttctttgctgcctagattaatttcagcaaaccatttctttccctctcccttccctgtatacatctccccacaccatctttcccagcagtgttttgtcccctccctatgtttttacatttactctcccaacagctgtctacaagcttatatgggatcccttgtattttatagaagctcttccttttgtagacctgtgaattcttagaatgctatgccccaaatcttctgtatatcacactctcaattaaatggagatttttgctgtttgcaagaatgtgagtcttaaaagagtgtgaagataaccaatctaaccctggaaaccccattcctttagaccaatcctttcccttctaacctcccctcccaggtttctcctaatttaggcaagtgtaactctcccagcaaagttgagaacattgattaaggtaatgcatgtgaagactctttgtaagctctaaagcactatagaaatgtcaccgatactgtttatctgtgaccttcatattataaagatcatgcccaagaagccagcagaggaagggaatgattagaagggagtgccagaaccatctgccctacaaaacgatctgaagcagctgtgccccccgggaaaagcaaatacctctgagaagattcacaagagatctggtaagaggaaacaattcgggaacaaaccctctggctttcctggctatgttcaggtgtgtggattgggtgtgtggcatggaccccagacaagtctaggtcccagctggactgaggagcttgcccagctccagaagagatgtcagacatgacttccagagacacagagtggagttgtcatccatataaaaaccacgtgacttggggcaagtctttcaaattttctcagctccagattcccagtctatgcgatggaaataaagaatcatagttcacaaattgtttggaggcattaaatttaatctagaaggcctgatgacatgaaaggtgctcaagcaattctatctgtaattacctgggatcatatcttacgcagctcaatgcctgataaccaatcaggtgtacttcagagatattgcaggttctgttccagaccactgcaataaagtgagtcacacatttttttgttattgtcatttcacagtgcataaaaactttatgtttacactatcctgtagtctattaagtgtgcaatagcattgtctaaaaatgtacataccttaattttaaaataattcatttataaaaaatgctaacaatcttctgagccttcagtgagtcacactctttttgctggtggagggtcttgcctcggtgttgatggctgctggctgatcaaggtggtggttgctgaagattggagtggctgtggcagtttcttaaaagaacacagcaatgaaatttgccacattgattagctctccctttcatgaaagatttccctgtactgtgtgatgctactggatagcattttacccacagtagaacttctttcaaagttggagtcaatcctctctagctatgaaagtcctagatggcatctccttccaatagaaggctattttatctacattgaaaatctgttgtttagtgtagccaccttcatcagtgatcttagctagatctcctggataacttgctgcagcttctccatcagggtttgctgcttcaccttgcacttttatgttatggagatggcttctttccttaaacctcacgaaccaacttctactagcttcacgtgtttcttctgcagcttcttcacctctctcagctttcatggtcgtgaagagagttcaggtctttctctgaattagactttggcttaagggaatgttgtggctggtttcatgttctgtcctgaccacgcaatcttcctctatttcagcagtaaggctgctttactttcttattcgtctgttcactggagtattagtatcattatttccttcaagacctttcctttgcattatatactattatttccttcaagaacttttcctttgcaatcacagcttggctgtttggtggaagaggccgagctttcagcctgtcttggctttcagcatgcttcctcactaagcttagccatttctagcttgtgatttagagtgagagacatgcgactcttcccttcctttgaacacttagtggccattgtagggttgttcattgtcctaatttcagtattgctgtgtctcaagaaatagggaggaccaagaaaaggaaggtaggcaaggaagagctcatcggtggagcagtcagaacacacacaacattgatcaattaagtttgtcatcctctgtgggtgcagttcctgttacccctaaaacaattacccacaacagggtgattattatcaataattacttaattgtacatttaaaaaaactaaaagagtgtaaatgaattgtttgtaacacaaggataaatggctgaggggatggataccctattttctatgatgtgattattatgcattgcatgcatgtatcaaaacatctcacgtaccccataagtatatacacctactgtgtacccacaaaaataaaaaaaatattttaaaagactaaagaacaacaaaacaattgcaatcataatatcaaagctcattgatcacagatcactataacagatataataataatggaaaagtgtaaaattggtgagaatttcaaaaaaaaattacagtatctgcgaagcaggataaaaatgaggtgccataaagcaaggtttgccttgtgcccttaacaaatacgtgcagcatgaaaggaggtatgggtgagtgttcccataagtgaagaggttgggaatctaaacctgacaacggaaggagccagaagctaaaactttaattggtatttgtcgtgtattggtgtggatctaaggcctcagcctctctaagccagagaatgtgaaaaactggataaagaaggcccatgggcacttggtggtggggaggcatctacttttttgagaaaacagagcctaacactctccaacccacccaaccctcactttccaactcttctccatcataggacccaaaagtgggaaacatgcctggacccacagactgcatgagagaaagcagctggtgatttatgaagagatcagcgaccctgaggaagatgacgagtaactccgtaagtgaacctcccgctcatcccccacatccctgcagatgtgctattctgttatgatactggtatcccatctgtcacttgctccccaaataattcccttttctagggtacagcattgaggctgaatgatgagatttcccattctctttctttctttcttttctttctttccttctgtctttttttttttttttttttttttggagggattcttgctctgtcgcccaggctggatgtggtggcccgatttcgcctcactgcaacttctgcatcccggttcaagcaattttcttgcctcagcaacctgagtagctgggattacacgtgtgcaccccacacacccggctaatttttgtatttttagtagagatgaactttccccatgttggtcaagctggtctcgaacttgcctctccacctgcctcggtctcccaaagtgctggatttacaggtgtgagccaccgcacccggccgatttcccatgctctttctactccctgccctgtatatccagagatgctccctacccaggatgctgtgggttcccaaaccccaggtcagccctgatatgcgggccacaccttcctctagcctaggaatcgataaaccaggtgaggaagtcactgtagcatgagcagatggttcacttcgaggaaccgtggaaggcgtgtgcaggccctgaggtagggcagaatcagagtgtgcagggtctgcaggtcaggaggagttgagattgagttgtcatgtggtgggaactcactgccactttctttccttctctcttcttgcctcagcctcagggatatgacacatgcccatgatgagaagcagaatgtggtgacctttcacgaacatgggcgtggctgcgaacccctcatcataaggtgcatagcaagtgaaagcaagtgttcacaacagtgaaaagttgagcgtcatttttcttagtgtgccaagagttcgatgttagcgtttccgttgtactttcttacagtgtgccattctgttagatattaacattttcactgttcagcaatacatgcttaatgcatatttcggtttgtgtatccatgcacctaccttagaaaacaagtatagtcaggtattctctccatagaacagcactaccctcctctctccccagatgtgactgctgaggggaggtctgagtgtttaatttcagattttttcctctgcatttacacacccccccacacacacacacaccaagtaacactataagcacctcccatctgcttgtactcccctcatccgattcccctctatcagtcactgacagttaataaacatttgcaaacgttccccagttgtttgctcctctcattattgtgcacacagctctctgcatgtgtatgaatatttctttaggaaagattcttagaagtggaattgctgtgtcaaacgagtcacttattcaacaaaaaactaatgagtgcatactcgtgctgagcgctgttctaggtgctggagagacatcagggaacaaggcagacagatgtttctgacccccattctagaggaggatgtttcccgttgttgggtttcttggtttgtttgtttgtttcttctagagatggggtcttgctctatccaggctagagtgcagtggcatgattatagctcaatgcagccttgaactcctgggctcaagtgatcctcccacagcagcctccagagtagctgtgactacaggcatgcaccatcacgccccgctgatttttttaggttttgtctagagagtctcactatgttacccaggctggtctccaactcctgggctcaagcaatcctcccaccttggcgtcctaatatattgggattacaggcgtaagccaccgcacctggccttcagtttttattttgatagagactatacacttcagtcctggagcaggattctgcagcaggtggttgggcatcttggccttcgctctctgaaccattttcgggttctagggctaggacagtccatttgggagtatgtgggaggagacacagatgaaatcgtcatctggggaatgtggagggatgaggaagatgcgtgcactgtagaccctgtgatggccagggaatagaagagtccacttagtctccatgcaaaggatcaatggtggaaaagtctcctgaacagaagcatgagactgcccatcaagggtctcaccaaccaagggcctgggggctggggtggggacgatgatttgggaatgggacagttctttctcacaggtcccactgcacggtgcggaggtgaaacagttgtggggaagggatgggcagagggaagtccgttttagaacaaaccagtgtgtgtgaatgaagacattaaacctccagtcacacacaacagacttgaaacaccagccccaggtggaggcaggattggagctgttttgaacatccatagcccatcaccttggcctcctgtttctccccagcctcagaaggagcacactatcatcattatgcctatatgatagatgagagacagagtcccagagagatggtaggcgtcttgtcacaggtcctacagctggcaggtgcaggaggggctgagtttggagctcactgacttcagaaacattaaggaggaaaggtgtgtgtggtggagggagggagaattgaacaaactccgggttctgtccccagtcgcaaggtagaggttgtgggttcattttccaagacaaggagcccttagagatggagagtgcagggaggaagaggcaatcgtggacatagtggggacagtgggagacagagatgtgcagcctgggcagaagaagggcaggcaaagaagcaggggatacccaaggccaagtgtgggctgtcacagccaccagagggagagggtgccaggaaggaggttgtggggctccaggagaaacagaggttccccagatctgtgagcatgccctgcctggcactgcaggaagaggtggctgccccccaggtcagtgtggacgtacctccacctgtgtctcagaggaaacaaattctattttatcccaatatagttctgtattacacaaatgtaatattccgatactagaaattgagtgccttatcctccatgcaaatagaggagaggataccctaaaggagatactgaaggatttgatttttctttctccctgggaagatgggatccataagtggggtcccccagcccacaagacaagtgcaaggaagggtggctggaagattgtgagttatgacagggaatatttttccttaggttccatgagtatataaagctcccaactatctgtctatcatggatagataaagagtgaacatggtcccctctccacaaatgtgtttctctccttcactattacagtgaaggtctgaagttccgtcaagttctgatacattacttttattactatttttcgtttttttcttttttctgagacagaatgtcactctgtcgcccaggctggagtgcagtggcgagatctcccactgcacttcccagttcgaaggaatgttgagtagggcatgggatctatctgccatcttgctccaatcatctggttttagatattttatgtacctttgtcactatatacgtgtaatttttctcaattaggatttctaaatggttattattggtatgcagaaaacctatctattactatatataatattttgttacctgtctgggtgcagtttcccctgccttttggcacaagactcaatctgttttattctcaaaaaaaaaaaaaaaaaactgataatctgggtgtggtggctcatgcctgtaatcccagcactttggtaggctgaggtgtgtagatcacctgaggtcaggagttcgagaccaacgtggccaagatggtgaaaccgcatctctacgaaaaacacaaaataaaaaaaaattagccacgcctggtggcgcatgcctgtattcccagctactagggcagctgagacgggaggatcacttgaactcgggaggcagagattgcagtgagccgaggtggcatcactgcactccagcttgggtgacagacattctatctctaaataaaaagaaaaagaaaaaagaaaaatcacttcacaggcaatagatagttataaaaggatactttatggaagatttcatagaggagactgatggaaagaaagaagtgtatattttacagagctgagcagttcacagcaaaaatcaccagaactgcctttttctccaaaattattacccctaagctattctactactggttcttctagtccttccctctattccaaatcctcaaattgtccattttcttattgcaataattttcctctgtgcagatctaggtcctccacaacacttagcactctcttcgagtgtttgcatgcccattgttttagctcaggttcccaacgaaacagaatttgggccattccagacacctctagacagactataccgagaaaccatgcctggaacggtgcagggggagaggagaggagagggaatttacatacctggctctcactcctggttccttttcttaacggtcaaaatttatcccacaggcacgagctcccctacacttctagattgcatcatctgcccccttggcagctgtctgggaagccagatcccacacttggaagtgtagtgtttcatacaatccaaaagtggtagcagaggccaggtgtggtggctcacgcctgtaattccagcactttgggaggc[132 bp omitted]tgaggtgggagaatcgcttgacctcgagaggcagaggttgcactgagctgagatctcaccattacactccagcctggacgacagagagagactcaatctcaaaaacaaaacaaaacaaacaaacaaacaaacacaaaagtggtagcagaagtcagaaagtccaggtatgtagctactttgcctagttgtaaagcagcagccaagggtgaaaactgaatactcccaggcaagtcctaagttcaccgagtaactggagtacccatctgtgttagttaattgcctttatctgaaggaaaagtaaaactcatgtctctgtgacaaccaggtgcttacagcttggagcgaggcacctaggctaaactcctctggtgacagggagacaaggacatcatcttcctcaatgttcacatttcaaagagatggcaccaaggccctgaagaaagacattcctaggggatgggcgtggtggctcatgcctgtaatcccaacactttgggaggctgagactggaggatcacttgaggcctggagttcaagttcaagacattcctgggttctaggatggccagaggcttacagatcaaaggaagaatttacaaatacaaattttctcaagaaaatgctctaaggaaagtgaaatggggaaaggtctcttcttcccttttggcaacaggaaaaattcaattttatgtttagttacccttacaatttcccccttttgttattgttttatagtaacactgcaattttctaattatctccactgctgtttctatctttctctgtgtagtttgcagccacctagatatccaacaaatccatagtaagatgcaaagcaaagcaattatcaggattataatagaatgatttttttttttcaggacggagtttcacttttgttgcccaggctggagtgcaacggtgcgatgtcggctcactgcaacctctgtctcctgagttcaagcgattctcctgcctcagcctcccgagtagctgggattacaggcatgtgccactacgcccagctaattttgtattttttgtagatatgcagttccaccattttagccaggctggtcttgaactccttaccccaggtgatccgcccaccttggcctcccaaagtgttaggattacaaatgtgagccaccatgccctgcctagaaagaattcttaaattcagtataatactccccttgtttgggcggggggacctttaaacacatcatactggttaattgtgtcaaagtcaaagtaaattatagagacaaatccctaaatcaaatgctgtatttgggaatcacaaaattgcaatccagggcatatacaaggactagggtggtcttcagtgtgtccaacgaacaaacagaagttggaaattttattagaaagaaaaatgttacatattgttttgaaatgaggctcattggccctagagaagctggttcattcacacaatcagctttcatattccctcttttgatcaacatctttgtttgaaaacctcactgattaaccatattaaagtgaggcttcattgtcactccatgccaggatggacatgggccggttgtctttgtcccatgtcaagggaaaggtaagggagtctagatcagggacatgggccatatttgagccacaaagaggccagaaggaaaaaaaattcaggtaggtttgtctggagttcagcatcaaattccatcttgttagtcccatctatattagcattcatcttgaagcactaggccaacattttcctgttggtagaactggcttaacaaatattagacaggcaacaagaatggagctcaaagatcataatacaaaagtaattagctatcgttattttattttattttattttattgcaatgcagtcttcctctgtcgcccaggctagagtgcagtggcgtgatcccggctcactgcaacctccacctcctgggttcaagcgaatctcctgcctcagcctctcgagtagcttggattacaagtgctcaccaccacacccggctaatttttgtcttttcagtagagacagggtttcatcatgttggccaggctggtctcgaactcctgacctcaagtaatccgccctccttggcatcccaaagtgctgggattataggcacaagccaccgcacccagctataattagcaatagtagaataaatttagtttgtacaatgattttgaactaagatcccaagcctaagggccaccagctaaacaaatcaaaagactatgggggaattgaatgagacctcttatagtctttgagtagcatttgaggactgggttgaattaaagcagagtgccaactctataaaagggaccactctataaaaaggattcactaggtgaatcaaaggatttgggagtcatggtctgccaagtgaaaaatgtagacattaaggggataagggtctcattatgatatgaagacttattctgatgtcttcggaaaagctgtctacaatgtggaatcgtcaacttctcatcctgatttgtggttcgaatgtctctggttatggcattcgacagtttggcgaactctttgtgtggtccatacatcagacacgagacttgttccttaaaatgtatgcagtttggatgggtgcagtggttcatgcctgtaatcctagcactttgggaggctgaggtgggcagatcatgaggtcaggagatagagaccatcctgggtaactcggtgaaaccccgcctctactaaaaatacaaaaaattagccggggatgttgtcacgtgcctgtagccccagctactcgagaggtttgggcaggagaatcgcttgaacgcgggaagcggaggttgcagtgagccgagatctcaccactgcactccagccttggcgacagtgtgagactccgtctcaaaaaaaaaaaaaaaaattatggtgtttttatcttagagtatttgtaaaccaaaaatagcatcctaagcacccccacccttaaccatctgaatggacgtcctcctcagcaagggctcttttaaaattaacctgggagactgttttaggccatgacaggacgtgttcgtcagacatgcctcattatacctctctggcatcaatatcaacacagacttaaatctcacaagaaacgtgttacaacctagtctctctgaagactagtacctgaaggcttcctctgcaaataagaacttgggtcaccacaatcctttatcttaacccaggcattcctttctgttgatcctaggcatgtttgtttgtttgtttgtttgttgttttgagacagagtctagatctgttgcccaggctggagtataatggtgcattctctgccaactgtaacctctgccacccggattcaagcaattctcctgtctc[136 bp omitted]cagcctcccaaagtgctgggattataggcatgagccaccaggcccggccaatcgtaggtttttagaaaacccaaccaattgtcaactagaaaattttttaatctacctataaactggaagcccctgcttcaagttgtcctgcctttctggaccaaaccaatgtatttcttaaatgtatttgattgagtcttcataaaatctataaaaccaagctgcacccaacctccttgggcaactcaggacctcctgaggctgtgtcatgggccgtggtcgctcctatttggctcagaataagtctcttcaagtgttttccagagtttgactcttttcatcagcaggcttcaggaacagagcaatttctgtttttagtaattttatgggaaaaagttggatctagtctagtctgtatgtagataacaagaactcggccaggcgcagtggctcaggcctgtattcccaccactttgggaggccgaggcgggcggatcacacggtcaagagattgagaccatcctggccaacatggtgaaacaccgtctctactgaaaatacaaaaattagccgggcgtggtggcatgcacctgtagtcccagctactcgggaggctgaggcaggagaatcgcttgaatgcgggaggcagaggttgcagtgagccgagatcccgccactgcactccagcctggtgacagagcgagactctgtctcaaaaacaacaacaacaacacaaaaagaaaaaaaaacacaagaactcgaaaaaatgcagagagctacaatctaataactggtctattagagcttttctttagcaacataatttttctctatacattgatcacttaggaatctcagatttaaaaacctcttgagcatagaaagtcaaaccaaggccgactttagatttcacctaccttcttaaggttcctgggcctgacagaaagtgaccgtttttattcacccactctaaagctaaaaacacttgaagtcaggcattccatgcattttgatgaaagccttggtaatacaaccaatttttttttctttttgagacagagtcttgctctgtcacccagactggtgagatctcagctcactgcagccttcgcctcctgggttcaagcaattctcctgcttcagcctcctgagtggctaggattacacatgtacaccaccatgccctactacattttttctttataatttttagtagagatgtggtttccccttgttggccaggctggtctcaaactcctgacctcaggtgatccacccacttcagcctcccaaagtgctgggattacaggtgtgagtcaccatgcccggccttataaccaatgtttttaattgtatctgtctataaagagagagcagatttttttgtgtgtgtttagaaaaaaggtgggtcaggtgcaatggctcacacctaaaatcccagagctttgggaggccacttgagcccagaagttcaagatcaacctgggcaacataactagacccccgttgctaaaaaaaaaaaaaaaaaaaaaaaagaaagaaagatagaaaagagaaaagaagtatggttttataactacctgcaggtagggcctgcatgaggcggcgggtgtacttgagagaagagaagaggaaaggaggagaggagaggggaggggaggaaagcaggggagaagggcgaagggagggggaggaaggggagggagggggagcggtggagcagcatggaggagggaatggttttattactacctgcaggcagggcctgcatgaggtggtaattgtgctgggcccagggtatgtgtgggctgtgagcagatggtgatggtgaggctggaaagaaaggggttggcttggaaaccaggcccaggggatcctcagatccgcttcttggaatgggcagccttgagaaaagagtcatggtaagccacagtcatgccatccatcagatgcagaaattcttggaaatctagctgcccatcactagtgaggtccagtttcttcatcatgtggtcaaagacactggggccctctggttcttcatgaaggcatccagttctgtattcatgaagcttgggaactccatcttggagtgagtgctattgtaaccatcctttccagcctatttctggaaaatagcaatcagggactctctgtagggctggagacttttgccatgttggagttgaatgaggcaccaagagcaggtttttactggacctgtgtgaataaccatattgccataggaatatttacaaatagtttttgaattctggaggaattgagtagtaagaaaaagcaaacatttccatctcagtttacaaaagtatacttcacaaaattattataaactatagatagtttaacagagaaaattttctctttgttttcatttttttgagaaaggattgtgccccgttgcacaggctggagtgcagtggtgcaaacacggctccctgcaacctctgggtcccaactcaagtgatcctcccacctcggcctcccaagtagctgggatcacaggcacatgccaccatgcccagctaatctttttatttttgtttttgtttttttagagacaggattttgccatgttgcccaatctggtcttgaactcccgggctcaagcgatcctcctgccttggcttccaaagtgagccaccacatcccaccagaaaattttcttaaatgtggaaaacaaaacatttaggtaaaaaacaaataaagttttattttcttaatttctttcagaaaccgggtctcctatatttcccaggttggtcttgaactcctgcactcaagagatcctcctgttccggcctccaaaagtgctgggatcagaggtgtgagccactgcacctagcccaagaataaataaagttttaaataaaggtcataaaaacattattggttatttagcctcatataattaatgtttgttctgcttgatcttgataatcagttgcatgaacccatcagttttcattagagttttcaaaaattatttatttagttcattgatctgaaagttattacaaatctatattcaacagtacttgttaaaatattttttaagaatctgattctggatgcctttagagaagaatcagcactgtagatgataaagcttagaatagtagcgatgaaaatctgacgaaagttcaataattgacaagaaaattcagttatttctattatagagagcattttaagataacaaccagaatcatgactaatagcatcacaccaggaccatcagacctctgtaaattttacatgatcttctgaacattaacgtcaataacatatctatgtaaatgtaaacagcgattagtattttttattatttgacattgcttttcatataatctaacatatcaaataagcctaatgagagacacattctttgaggctctccaggggcctcactggtaaatctcaaagtcaattttaggttaaaaagacttaaattagagtttgattagtttgttcaacagcagtagttaaattaaaaaagaattgcattttggggaagtttgtcaaagatgttaaaaggctcaaaacacttgtgcaaaacaggatcatgggtcactgtggaaataatagtcactcatttaaccagagtgatagtccacagacttcaaaagcaatacagaaagttacacggacttaaaaacttaccctttcaaagctcagttttcctaagcaagaagaaacctaattagtaggccgggcgtgttggctcacgcctggaatcccagcaccttgggaggccgaggcggacagatcacttgaggccaggagttcaagaccaggctgagcgacatggcaaaaccccttttctactaaaaggacaaaatattagctgggtgtcgtggcccacgcctgtggtcccagctacaggaggcaaaagaattgcttgaacccgggagacaaaggttgcagtgagccaagatcccgcccattgcattccagcctgggcgacagagagagactccatctcaaaacaaaaccctaggatcaacagaaaggaatgcctgggttaagataaaggattgtggagacccaagttcttatttgcagaggaagccttcaggtactaggcttcagagagactaggttgtaacatgtttcttattagactgaaagtctgtgttgatgttgatgccagagaggtataatgaggcatgcctgacccccacttcctgtcatggcctgaaaccatctctcaggttaaattttaaaagagccctggctgaggaagaagtccattcaaatggttgtgggttggcgggggataggattttatttttgatctacaagttctgtaagataaaagtgcatacattttaaggaacaagtctgctgcctgatgtatggaccacacaaaaagttcaccaaactgtccaatgccataaccggagacattcgaacgacaaatcaggatgagaagttgacgtttccacactatagacagcttttcccaagacgtcagaataagtcttcatatcgtaatgagactcttaccccctgaatgtctacatttttcacttgacagaacccgacgcccaaatcctttacctcacctagtggtccctttagagttggcactctgctttaattcaacccagtcctcaaatgctactcaaagactacaagaggtctcattcaattcccccatagctttttgatttgtttagctggtggcccttaggcttgggatcttggttcaaaa[134 bp omitted]caacatggtgaaaccctgtctctactgaaaagacaaaaataagtcagtcatgttggtgggcacctgtaatcccagctactggggaggctgaggcaggagaatcgcttgaacccgggagatgtaggttgcagtgagccgggatcacgccactgcacttcaggctgggcgacagagcaagaatccattgcaataaaataaaataaataaaataaaataaaataaaataaaataaaataaaataaaataaaataaagtaaaataataaaataaataaaataaaataaaataaacaattgctaattattttagaattatgatctttgagctccatacttgttgcctaatatttgttaagccagttctcccaagaaaataatgttatcccagtgcatcaagatgattgctaatatagatgggactaacaagatggaacttgatgctgaactccaggcaaacctgcctgaaattttttttccttctgtcctctttgttgctcaaatatggcccatgtccctgatctagactcccttacctttcccttgacatgggataaagacaaccggcacaggtccatcctggcatggagtgacaatgaagcctcactttaagatggctgatcggtgaggttttgaaagaaagatgttgatcaaaagagggaatgtgaaagctgattgtgcgaatgaaccagcttctccagggccaatgagactcatttcaaaacaatatgtaacatttttctttctaataaaatttccaacttctgtttgttcgttggacataatgaagaccaccctagtccgtgtatatgccctgaattgcaattttgtgattcccaaatacagcatttgatttagggatttgtctctataatttattttgactttgacacaattaaccagtatgatgtgcttaaaggttgccccaccccctgacagggtgagtattatactgaatttaaaaattctttctaggtagggcatggtggctcacatctgtaatcctaacactttgggaagccgaggtgggtggatcacctagggtgaggagttgaagaccagcctggctaaaatggtgaaatcccatctctaaaaaaataccaaattagctgggcgtagtggcacatgcctgtaatcccagctactcaggaggctgaggcaggagaattgcttgaacttaggaaacagaggttacagtgagccgacatcgcaccattgcactccagcctgggcaacaagagcgaaactccatcccgaaaaataaaaaatcattctattacaatcttgataattgcttagctttgcatcttactatggacttgttggatatctaggtagctgcaaactatgcagagaaagatagaaacagcagtggagataattagaaaattgtagtgttcctataaaacaattaacaaaagggggaaattgtaagggtaactaaacataaaattgaatttttcctgttgccaagagagaagaagaaacctgtctccatttcactttccttagagcatttcctttagaaattttgtatttgtaaattcttcctttgatacgtaagcctctggccatcctagaacccaggaatgtcttgaacttgaactccaggcctcaagtgatcctccagcctcagcctccaaaagtgttgggattacaggcatgagccaccatgcccgtcccttaggaatgtctttcttcagggccttggtgccatctctttgaaatgtgaacattgaggaagatgatgtccttatctccctgtcaccaggggagtttagcctaggtgcctcgctccaagctgtaagcacctggttgtcatagagacatgagttttatttttccttcagataaaggcaattaactaacacagatgggtactccaattacttggtgaacttaggacttgcctgggagcatttagtgttcacccttggctgctgccgtacagccaggccaattaccaacatatctggactttctgatttctgctaccactttttattgttcgtttgttttgcttttgtttgtttttgttttgttttgtttttgaggcggagtcaccctctgttgcccaggctggagtgcagtggtgttatctcagctcattgaaacctctgcctcccagattcaagcgattctcctacctcagcctcccgagtagctgggattacaggcgtgtaccaccatgcccaactaatttctgtatttttagtagagacggggtttctccattctggccaggctgatctccaactcctgacctcatgatccgcctgccttggcctcccaaagtgctgggattacaggtgtgagccaccacgcctggcctctgctaccacttttggattgtatgaaacactacacttccaagtgtgggatctggcttcccagacagctgccaaaggggcgggtgatgcaatctagaagtgtaggggagttcatgcctatgggatatctattgcctgtgaaatgaattttcttttttttctttttcttttttatttagagacagagtctctgtcacccgagctggagtgcagtggcccgatctcggctcactgcaatctctgcctcctgagtttatgtgatcctccctcctcagctgccctggtagctggaactacaggcatgcaacaccaatgcctggctaagtttttcatttgtatgtttagtagagaagggggttcaccatctt[140 bp omitted]aaatgcaggggaagctgcacccagacaggtaacaaaatataatatacaatcatagataggttttctacataccaataataaccatttagaaaaccaaattgagaaaaattacacgtatatagtgacaaaagtacatacaatatctaaaaccagatgattggagcaagatggcagatagatcccgtgccctactcaacattccattgaactgggaagaaaatgttttcaagggtcaattcttaacagtagaggaaaataggaaagcgtgtcagcggtccaccagaaatattgaggcattcctgggagatagagtagatggggtcagactgatagagaaacccaaggagacaagaccacagctcaaatcactgtaggcgagagatgctgtttgctttttgagacagacttactctgtcgccaggctggagtgcagtggcgtgatctcggctcactgcaccctccgtctcccaggttcaagggattctcccacttcactccctgcagtaactggaattcacaggccagcccaccactactgcctaatttttgtatttttagaagagacgggggtttcaccctgttggtcaggctggtcacaaactcctgacctcaagtgatctgcctgccttggcctcccaaagtgctgatattacagagtgggtcaccgcgaccgcccaggagattctctttgtaacaaagcctctgaaaatccccaaaccctaaatcaaaaaaaacacggagctggaaagggccttaggataatcatcatgtaggttaatttaaaagttcattagaggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcccaaggacaaaaaaccaaacaccgcatgttctcactcataggtgggaattgaacaatgagaacacatggacacaggaaggggaacatcacacaccggggcctgttgtggggtggggggagggtggagggatagcattaggagatatacctcaggttaaatgacgagttaatgggtgcagcacaccaacatgggacatgtatacatatgtaacaaacctgcacgtcgtgcacatgtaccgtagaacttaaagtataatttaaaaaaaaaagttcattagaaacatctgaatcagccagattccccttcaacaccacagacagattggctggcagtagccacttttgcctctaagatgaaaaatctgataattgctcattaaagaaagtgaaggcctggcgaggtggctcacacttgtcatcccagcacattgggattgggaggctaagggaggaggattgcctgaggccaggggatccagaccagcctgggcaacatagtggatgccgtctctataaaaaaatacaaaaactagctgggtgtggtggcgtgtgcctgtagtcccagctagatcggaagctgaagtgggagaatcccttgagcctgggagatcgaggccgcagtgagctgtacttgcatcactgcactccagcctgggcgacagactgcgatcatgtcaaaaaaaaaaaaagtaatatatcaggacttggtgtaacttcagccctttacagtaataatgaaggagagaaacacatttgtggagaagggaccgtgttcactctttatctatccatgatagacagatagtcaggagctttatatacccatggaacctaaggaaaaatgttccctgtcataactcacaatcttccagctacccttcctggcacctgtcttgtgggctgggggacccaacttatggatcccatcatcccagagagaaagaaaaatcaaatccttcagtaagtatctcttttagggtatcctcttctctatttgcttggaggataaggctctcgatatctagtagccaaatgttgtgtaatacagaactatattgggataaaatagaatttgtttcctctgagacacaggtagaggtacgtccacactgacctgggtggcagccatctctttctgcagtgccaggcagggcatgctcacagatctggggaacctctactgctcctggagccccacaacctccttccaggcaccctctccctctggtggctgtgacagcccacatgtggctttgtgtctcccctgcttctttgcctgcctctcttctgcccaccctgcatatctctgtctcccactgtccctgctgtgaccacgactgcctctccctccctgcactctctctctcctagggctccttgtcttcggtaaatgaacccacagccttcacattgtgattggggacagagcccggggcttgttcaattccccttccctccaccacacacacctgtcctccttaaagtttctgaagtcagagagatccaaacacagctcctcctgcacctgccagctgtgggacctcagacaagacgcctaccatctgtcgggaactccgtctctcatctattatattggcataatgatgatagtgtcctccttcgaaggctggagagaaccagaaggccaaggtaatgggccatggacggtcaaaactgctccaattctgcctccacctggggctggtgtttcaagtccattgtgtgtgaatggagctttgatgtcttcattcacacacaatggtttgttctaaaatagactcccctctgcccttcccttccccacaactgtttcccctccacactgtgcaatggtacatgtgacaaagaactgtcccattcccaaatcatcgtccccaccccagcccccaggcccctggttggtgagacccttgatgggcagtctcatgcttctgtccaggggactttcgtaccgattgctcccctgcatggagactaagtggactcttctattccctggccatcacagggtctacagtgcacacatcttcctcattccttcatgttccccagatgacgatttcatctgtgtctcctcccacatactcccaaatggactgtcccagaccttgaatccggaaatcattcagagagcaaaggccaagatgcctaaacacctgctgcagaatcctgctccaggactgaaatgtatagtctctatcaaaataaaaactgggggtcaggcatggtggctcactcctgtaatcctagtagtttaggaggccaaggtgggaggatcgctttggcccaggactttgagaccagcctgggtaacagagcaagactttcttgacaaaacctaaaaaaattagtggatcatgatggtgcatgcctgtagtcacagcttctctggaggctgaggagggaggattgcttgagcccaggagttcaaggctgcattgagctatgatcatgccactgcattccagccaggacagagcaagactctcatctctagaagaaacaaacaaacaaataaaacccaacaactgcaaacatccttctctagaatggggtcacgaactcctgtctgtcttgttccctgatgtcgctccagcacctagaacagcgctcagcacgaggacgcactcagtgttttgttgaataaatgactcctttgacacagcaattccacttctaagaatctttcctaaagaaatatgcacacacgtgcacagagctgtgtgcacaataatggcacgagcaaacaactggggaacgtttgcaaaggtttatttactgtcagtgactgctacaggggaatcggatgaggggagtacatgctgaccaggaaacagagtgagggaagcctgaccaggacgcatggcaatgggaaaagcagatgggagatgcttatactggtacttggtgtgtgtctgtgtgtgtgtgtgtgtgtgtgtggtgtggtttgtgtgtgtgtgtaaatgcagaggaaaaaatctgaaattaaacactcagaactgccctcagtagtcacatctagggagagaggagggtaatgctgttccatgcagaggtaactgacaatacttgttttctaaggtaggtgcatggatacacaaaccaaaatatgcattaagtatgtcttgctcatcagtgaaaatgttaatatctaacagaatgacacacttcaagaaaatacaatggaaacgctaatatcgtactcttggcacactaagaaaaatgacgctcaacttttcactgttgtgaacacttgctttcacttgctatgcacctgatgacgaggggtccacagccatgcccatgttcgtgaaaggtcaccacgttctgcttctcatcatgggcatgtgtcatatccccaaggctgaggcaagaagagagaaggaaagtaagtggcagtgagttcccaccacgtgacaactcaatctcaactcctcctgacctgcagaccctgcacactccgattctgccctatctcaggacctgcacacaccttccacggttcctcgaagtgaaccatctgttcatgccacagtgacttcctcgcctgggctatcaattcctaggctagaggaaggtgtggcccgcatatcagggctgacctggggtttgggaccccacagcatcctgggtagggagcatccctggatatatacagggcagggagtagaaagagcatgggaaatctcatcattcagcctcaatgctgtacactagaaaattataagaagggaatgatttggggagcaagtgacagatgggatgccagtatcataacagaatagcacatctgcagggatgcaggggatgagtggaaggttctcttacggagttactcatcatcttcctcaggatcgctgatctcttcataaatcaccagctgctttctctcacgcagtctgtgggtccaggcatgttccccccttttgggtcctatgatggagaatagttggaaagtgagggttgggtaggttggagagtgttaggctctgtttactcaaaaaaaggagatgcctgcttcctcccaagtgcccatgggccttctttatccagtttttcacattctctggcttagagaggctgagaccttagacccacaccaatataggccaaatgccaattaaagttttagcttctggctccttcccttctcaggcttagattcccaacctcttcacttacgggaacattcccccatacctaatttcatacagcacgtatttgttaaagccacacaggcataccttgttttgttgcacttcatgttcatactgcttcgcagatgctgcaatttttttttttggaaattctcaccaattttacacttttccattattattatatctgttatagtgatctgtgatcagtgagctttactattattactaaaattgtttttgttgttttttagtgttttaaaataatttttgttctttattttgtgggtacacagtaggtgtatattcttatggggtacatgagatgctttgatacaggcatgcaatgcatgataatcacatcatggaaaatagggtatccatcctcaagcatttatccttgccttacaaacaatccatttatgctcttttagtttttttaagtacaattaagttattattgactataatcaccctgttgtgtgtaattgttttgggggtaccaggaactgcacccatagaatatgacaaacttaatcgattaatgttttgtgtcttctgactgctccaccgatgagctgttccgcgtctctcttccttttcttgggcctccctatttcctgagacacagcaatactgaaatgaggattattaacaaccttacaatggccgttaagtgttcaaatgaaaggaagagtcgcatgcctttcactctaaatcacaagctagaaatggctaagattagtgaggaagcatgctgaaagccaagacaggctgaaagctaggcctcttgcaccaaacagccaagctgtgaatgcaaagaaaagttcttgaaggaaataatagtatataatgcaaaggaaaagttcttgaaggaaataataatactaatactccagtgaacacacgaataagaaagcaaaactgccttactgctcaaatagagaaagtttgagtggtcaggatagaagatgaaaccagccacaacattcccttaagccaaagtctaattcagagcaagaccagaactctcttcaaatccatgaaagctgagagaggtgaagaagctgcaggagaaacctgtgaagctagcagaggttggttcgtgaggtttaaggaaagaagccgtctctataacataaaagtgcaaggtgaagcagcaaaccctgatggagaagctgcagcaagttatccggaagatctagctaagatcactgatgaaggtggctacacgaaacaacagattttcaatgtagataaaatagccttctattggaaggagatgccatctaggactttcatagctagagaggattgagttcaactttgaaaggagttctactgtgggtaaaatgctatccaatagcatcacatactacagagaaatccttcatgaaagggagagctaatcgatgtggcaaatttcattgttgtgttcttttaagaaactgccacagccactccaatcttcagcaaccaccaccttgaccagccagcagccatcaacaccgaggcaagaccctccaccagcaaaaagagtgtgactcactgaaggctcagaagattgttagcatttttaacaatgaattattttaaaattaaggtatatacatttttagacataatgctattgcacacttagtagactacactgtagtgtaaacataacgttttatgcactgtcaaacaaaaaacaatgtgtgtgactcactttattgcagtggtctggaaccgaacctgcagtatctctgaaggacacctgtattgggtaacaggcattgagctgagtaagatatgatcccaggttatcacagatagaatcgcttgagcacctttcatgtcatcaggccttctagattaaatttaatgtctccaaacaatttatgaactatgattctttatttccatcttatggactaggaacctggagctgaggaaatttggaagactttcctcaagtcacgtggtttttttttatatggatgacaactccagtctgtctctggaagtcatgtctaacatctcatctggagctgggcaagctcctcagcccagcctggacccagggttatctgggatccatgccacacacccagtccacacacctgaacgtcgccagggaagccagtgggattgttcctgaattgcttcctcttaccagatatcatgttaatcttctcagaggtagttggttttcccggggggcacagctgtttcccatcgttttgtgggccagatgcttctggcacttccttcgaaacatttccttcctctgctggcttcttgggcatgatctttataatgtgaaggtcatagataaatagtatcagtgacatttctatagtgcttttgagcttacaaagggtcttcacatgcattagcttattcaatgttctcaacaacactgggagagttacacaggcctaaattaggagaaacctgggaggggaggttagaagggaaaggaatggcctaagtgaatatggtttccagggatagaatgcttatcttcccactcttttaggactcacattcttgcaaacagcaaaaatctccatttaattgagagtgtgatatacagatgatttggagaagagtagcattctaagaattcacaaggtctacaaagggaagaggttctgtaaaatacaagggatcccatataagcttgtagacagctgctgggagagtaaatgtaaaaacatagggaggcgacaaaacactgctgggaaagatggtgtggggagatgaacacaaggaagggagagggaaataaatggcttgctgaaattaatctaggcagcaaacaaagcagtaccagatatgacatactaccctaccgaggcaccaattgaatgtggaattcagtgaggtggtacccataccaattctggttgcattgggatgtgtactgaccaacaatcttaagctgctttctttttcttttttttttttttttttgagacggagtcttgctgtgtcgccagaatggggagccgtggcatgatatcggctcaaggcaatatctgactcccgcgtttaagcgattctccttccttagcctccagagtatctgggactacaggcaggcactaccacgccccactaagttttgtatttttagtagagacgaggtttcaccatgttgggcaggatggtctcgatctcctgaccttgtgatctgcccgactcagcctcccaaagtgctgggattacagtcgtgagccaccgcgccctgatcttaagctacttttaattcagcttcctcccttatgaaatagtgaaccatacatgtaaaataggctacaagaaagtgctctctgagcttgtaaacactctttaaatgtagtaataataacaattaatacctttcacaatccttctttgaattcagtctccacactggcaacccaactcccagatccctttaccctccaaaccagagttgaatctgcacttgtgggatcactcattcaggggcctccgagggatcccctgggctgggactggggcttcccagacgccccaggtgcagacaaggcactcaaggagctcacagtagggaggggccaacaatcaaagcgattcctaagccatgcaagtggccccagtaacacagcagagaccagatggtccttcctgttgcgagagtgggtgtctcaatggaagcaccagcaggccctatggggtgaagccctagtgagcaacatctgaacttcataaacaaatgcaaacgtgaatgagctttaaatggcttggagctctggattagactaccactgacactgcgcctcaggaaaattctttaacatctctgtaccacgatagcctcattttattattatgttgctgataactatgatctaaaacataaactataattctttacttccatttcatggaccaggaatctggagctcagagaactcagaagatttgtgccaagtcatatggctatcatatggatgaaaactgaaatgtgttactcattattattcggagataatagaaacaatgtcttcttaaggattaaataaattaatccatgtgaactgcttgaaatagtatctggcatcactatgaaaacaaaagaggtatgaacaatcacaaatgttggtactatcaagccgtcggtgctacatcaggtgttgtgatagacatggggagaagaaggcagtgagggcattgttgatattctcccactcttaccagtgttcgcatccttggagggacaaaggttctctggtcctttagatctgaaagatactcaccttcgggaagattccctggagcctgccgaaagtcatctgaggacgttgaactgaaagagaatacatcagaatttttcattgttggtaaaggtttccaaactctagagagacttctgtcgcatcagggtattctgcagcagaggcttatgagtccacgcattgttgaggagttatttcagatttgcttctgaattatgtttagtcatggttgatgcatttatctgtggcatcaattcagaattttccatctcatggtttatcacatggggactacaccccatcacagtctcatcttattcgattacatatcttttactttttcccaaataattaaattgattggttaggaatctgaactgtatccactcaagatgtgcaacaactgaaaatcattgtacacttcaaatgggtgaatcttatggtatgtgaattaagctgttaaatgtgtggtgaaccacggatgatttggtccagtggctctgaaagattttcagtacaaagacagtcctttaacgttaaaaacttggcagatactcaagcactggcttttcagatctcttatagtgattgcgggagattgtagaatctggcctgtttagttggcgagtaataggtctattggagacggtttggacattctgaccttgtcttataattatgttgtcagagtagaagagcaagtaaatacatatgtcccctttattttcctgaaatgcacaaagctctctacccaagaacctgtctttttttcatcctatgttatctctgttctctgacaagtgggaaagctctctgtgttttcgataagggatcactctttcaaactctctttcaagctcatcacagagaatcagggttatttgggaatgagaagactatttggttttgataaaatacagagaaacagcgatctttattacataatgtgttcatcaacctcactcctaagatacctatccaatacctacatgctgttaatgaaacaacctctggaagtttttggcggatctacagttttaacactttctttcttttttttttttttcacttgtaacattttcttaactgtcctttgatacattaacagtgcttaggaagaacaacatgtcatttaaaaaagaaatatttcaaacacacagaaaagtatggggaataatattgagtccagtcggatctcaacattaccccacagctaagttaggtctgatttatttattcagaatattagaaaaactgcaaacaggccgggcgtggtagctcacacttgtaatcccagcagtttggaaggctgaggcgggtggatcacctgaggtcaggaagtttgagaccagcctggccaacatggtgaaaccccgtctctaccataaattaaaaaatgagctgagtgtgggggcacgtgcgtgtaaccccagctactcgggaggctgaggcagaagaatcacttgaacccaggaggtgaaagttggagtgagctgagattgccttattgcactccaccctggccgagaagagtgaaactccatctcaaaaacaaaaacaaacaaaacacactatcaacaagtcacagctgaagctgtctgtgcagcactcagcaatccctgccctccctccctcctccacttacagccagtcaccttagtttgatggctttttattcacattcatgtttgtatacatttaccatttacttattatccataaaaatatatattcttcttttgcatgttttaaaattttatatgaatgacctctgtagttaactttctgcatgcaattttttttttcactctgccccgatgtgtatgagggaacaaatgcctgaggctctttcccaggtagctgagctgaaaagcaattgggcttgaggagaccctttccagccccttcccatctactcaccctgattcccacggttagggtcattatcaaaatcattcccctggaagtctgtgacccgtttattacgcatgaaagatgggaggatggccttgaaacctagaaagaagcaaaatgtttattccttaagagacaagcttgggcctggtacggtggctcatgtctgtagtaccaacactttgggaggctaaggctggaggattgcttgaggccaggaattcaaggctgcagtaagctatgattgcactactgcactctagcctaggtgacagattcagactgactcaaacaaaaaaaaaaaaaaaagaaagagacaagccgagagaaggtagagtgggtgtgtgtggggtgggggtaggatggttgccgggatgccacagagacagttgggctcatcagaacagaagcctaagagagagaaacgtgcaggatccaggtatgagctccactgtggccagtcactgccctcagccctgacaggatatagaagagcagaacacccagaagctgccttgcgatttttccctacacaaaaggaaaatgtgaggtactttctgcagcctaagaaatagccaaagcaggaaaagggatgctcatgtgtccccagacttgtctgtacctagaactttctgttacctagtttagtcatggcctcatactttctcttcatatacacatagacgattttctccgagactttcatcttttcccactcttccttagagaagtatttggcaatatcatcgaaggcctacaaaaaaaaaaaaaaggaattatggcagggactcagctaggcatgtctgccattcagctggagtcgcttcctgtgtgctggatctgggaagtggggataatccttcctggttgatgccacggctaactgacagaacatgagggaccttcctagcttcacccctgccacactgtcgggctttaatgctgctggctggctctcctcccaccttccagaatggactgagagtcaccaaatgtagtgcaaggtcacagacttgtctccagggatgctaggtgatgacagagtgagggtgggaggctcccaagggtccagatctcccctgagaccctgctccttgtctccagtatctctgtcctcccctcctcagaaaccgggtcaccccacactgtcccctgggtcactactctgctccctctaggtcacctcaccttttgtatcttctctggtatttgagcaccaaccgtgggtctccttgcaaaggtgtcatctccgttcatggcacagggagtagtctgacctgcaagagaaacagattgagactttccagccgcaggacctttggtcttgtggagggagaaatcagtgaaggccggccactcagtcacctggaatcaggtgctgcatttctccatccggggcttatctgtccctgagtaaggatatggggagaaatcagacgaaaaccaggaaccaggggtctctgggagaagtattgataggggatgacaggtttcctatgggcaaagcagccttgagtctttgggagggggttggctaatgttgttagtaatttccctggagctaggcttcccctgaaagatgtatggacccttgttggggaggcagggacatgactgtgtaattttattcagtggggcatgctgacacccccgctcaataaataaaggaagggaagttagtcccagagataacgtggtctctttggtgatggatctgatcaggcagagggatggggggttctgttctgctgaagagaaatgagcatcgctaatatgaatgtgttcagaggctattactgggtgatttgtaagttattagaacgaagagagctagaatttctgagactacaagagcccgccatcacttagaga[134 bp omitted]aaacccccgtctacaaaataaacaaaaagttagctggggttggtggagcaggcctgtaccatcccagcactttggaaggccaaggtgggcggatcgccttagcccaggagcttgagaccaggctcacaaacgtagcaaaaccatctctactaaaaaaaacaaacaaacaaaatttagcagaagcggggtggtgcgcgcctgtagtcccaaggcctaggtgagaagatcacttgagcccagcaggaaagatttgagtgattttttttttcagacagggtctcgctctgttgcccagtcgggagtgcactggcgtgatcatggctcactgcaacctccgcctcttgggttcaggcaatccaccagctgtggcttccaaaagtgcagggattacaagtgtaagccaccaccccaggcccaaatttcttaagttactacagagttcctaggaaaaatcccatacctgaaaaagttagaaactgacaggaaagatttgagatggcggttagaaactgacaggaaagatttaagatggcggcctgcctcatatacactccttattaaaactagatagcaaatgcaccacggaggaggggaggggtaggaagaatggaaaaagaaaatcagtgtattcttactctgattttggaagaatccaaagagaaaatcagaccgtgcgtactcttgagtatggaagaatcgaaagagagagaaaatcagagcatgcgtactctgaacttaaagtagcgaatcccaggggatgctttaggcgggaaaattagagtctccacccccactttgagaaggttgtgtccctggagccgggactgatagaagccacatccgcttcgcttgttccgcctactgttctgacttctaattggccagatggagttcactaactgccctgattggtccatcatccttgggcagcgacattgcagaataatgtctcctcctccagccacaccttgtcgccactgcgaaaaagtgggtggtcctcaggcgccgtcagattttgatctctctgaagactgttcctggatcttgggttaaaaatctggattctagtctgaactgtgggaagaaaaaaatagtcaatctgtgatttttctacttgaaagccacaatgttttccaaactagcacatttgcggaggtttgctataattagtcgtggagttcattcttcagtggcttctatatctgttgccactgaaaaaacagtccaaggccctccaacctctgcttacatttttgaaagggaatctaagtgtggtgtgcagaattaccatcctttacctgtagccctggagagaggaaaatgtatttacttatgggatgtgattgtggtattggttacatctgccttggccaatcctcccgcctctgtctcgggactacaggcgcaaaccaccccacccccactaatattttttattttttgattttttaatagagaaggttttgctgtgttggccaggctggtcttgacgtcctgggctcaagcgatcctcccacctcggcctcgggactacaggcattcaccaccctgcctacgcttttttttttttttttttttttaagtagaaaccaggttttgctatgttggccaggctggtctcattggccaggttggtctcatcgtcctgggctcaaggcattcttccaccatggcctcgagactacaggcatgcactaccctgcctacgattttttttttttttttttttttttttttagtagaaaccatgtttccctatgttggccaggccggcatcaagctcctgggctcaagggatcctcctgcctcaggaccgcagccacgcaccaccctgcccaagctattttttgttttgttttgtttcgttttagtagaaaccaggtttcgatatgttgcccaggctggcctcaatctcttaggctcagatgatgctttcatcttggcctcaggactataggcgtgtgccattctgccctgctcatttttattttcatttatttatttatttatttatttatttattttaggagaggcaggctatcgctttgttggccaggctggtatcaacctcctgggctcaagcaatcctcccaccttggcctcaaaactacaggagtgagccaccccacccacgctatttttttgttgttcttgttgttagtagaaatggggtttcactatgttggccaggctggcctcaacctcctaggctcaagcaatcgtcctgccttggcctcgggactacaggttcacaccaccccgcccccactaatatttttaatttttctactagagacagtttcgctatgttgtccaggctggtctctacctccgggactcaagtgattctcccgcctcggccttgggactacaggcatgcactaccctgccttttgctatgtttcccaggttggtcttgacctcctgggctcactcaatgatttgaacctgggaagccgaggttgcattgagctgagatcacaccactgcactccagcttgagcgacagagcaagactgaaaaaaaaaaaaaaaagaaagaaagagcaagagagagatcagcggaatctccgtaagaacagggagctttgtggtattttaacttacccttgtcccatctcgtgctcccagcttggttctgttcattgctgatgaaatacagataggattggccagaactggtagatggctggctgttgatcatgaaaatgtcagacctgatatagtcctccttggaaaggccctttctggaggttgatactctgtgtctgcagtgctgtgggatgatggcttaatgctgagcattaagccaggggaacatgggtccacatacggtggcaatccactaggctgctgagtgaccatcgcagcccttgaggttttagaacaagaaaatcttgctgaaaatgcagaaaaaaaatgggtattatcgtgagaagtgaacccatgaagctaccttctgatgttgtaactgccataaaaggaacagaattattattattattattatttgagtcagaggttcactctggttgcccaggatggagtgcaatggtgcaatcttggctcactgcaacctctgcctcctgggttcaagcgattctcctacctcagcctcctgagtagctgggattacaggcatgcaccactatgcccagctaatttttgtatttttagtagagacggggtttcgccacgttggccaggctggtctcgaactcctgacttcaggcgatccacccgcctcagcctcccaaagtgttgggattacaggcgtgagccactgtgcccgggaggaaaataattattaaatgctattgttattaaagaaaccatagactgtaatgcttgggaggtgtgtctatgacttcgagattatggacttctggccaagcccacccatggtgacatcatcaggtttcgcctctgctggtgatcaaggaggatgagattcgagagtccagtgaaatcattaacaagaccatcttgccgttctgagggtagcagctgttttcagtggttcctgggagccggctggagacaggtggtcctgtaaaagctctgctctaaatgtaggcacattccactcccatgtgtcttcaaaatctttttgtgtatatatgttttttcagttgatacataataggacaatgtttatgaacctgacatttgctttgtagtgttaagagaatgtaatggcatctatattcagtgaaagtgttttgatgtgcacgtgtactttataaggtgaaatgcatctgtatatacagacagcctttaaatcacatccttcagtatactttatatatgcttttataatttccttgctggtataaaggttttgtatttgaaaaagatatctctagcgtattacataaaaggcttcaccttataaagtcaaatcattgttttcattgaattttaggaacgatcaatggttaagcatataaaaaatactagtttttttgttttgtttttgtttttgtttttgttttgagacggagtctcaccctgtcacccaggctggagtgcagtggctcgatctccgctcactgcaagctccacctcctgggttcacgccattctcctgcctcagccttccgagtggctgggactacaggtgctcaccaa[138 bp omitted]cccggcctataaaatactaatattaagtaaactttatattgaccaacaccaggatatagtctatggatgtcattattttgaattaagaattagtgtttaacattcctaaattgttttgagtgcttgattataatttgtaaaaaaaagtttacttttaatatttctttacattttaaacaaagcttgtatttcagaaaaaaaaacagacagaacatggccgggtgcagtggttcacgcttgtaatcccagcattttgggaggccgaggtgggcagatcacttgaggtcaggagtttgagaccagcctggccaacatggagaaaccccgtctctactaaaagtacaaaaattaaccaggcatggtggcacccgcctgtagtcccagctacatgggaggctgagacaggagaatagctcaaacccaggaggcagaggttgcagtgagctcgagagcgtgccactgcactacagcctaggagacagagtgagaatccctcttgaaaaaaaaaatgtacagtacattttcatcaccgcaatgctatcccttgtgctactcatttttagtaatactctcctcccatccgccatccctaatccctggcaaccacaaatctgtttttcgtttccacaattttgtcttttctacaatgctgtacaagtgaaatcttatagtatatcatgttttatgggcttatttcactcagcataattccatggagatttctccaagatattgatatttgtgtatcaatagttcattgttgttgttgttgagacagagtctcactctgtcacccaggctagagtgcagtgtctcggctcactgcaacctctgcctcctgggttcaagcaattttccagtctcagcctcccgagtagctctgactacaggtgcgcgccaccacacccgggtaatttttgtatcagtagtaaagatggggtttcaacatactggcaagtctggtcttgaactcctgacatcatcatccgcctgcctcgacctcccaaagtgctgtgataacagggtgagccactgtgccctgacaatagttcatttttattgctgagtagtattccaggggatggatgtagcacagtttgaccattcacttattttaggacatattgattatttccacctattggctattacaagtaaagctgctatgaacaattatgtacaagtttctggatgggcatacattttaatttctctgaagtgtaattgttgaattgtatggtcattgcatgtttagttttataagaaactaccaaactgctttccagagtggctgtaagattttaccttcccagcagcacttaataaggtgtccagtttctctgcatccttgtcaccatttggtgttgtcactatgtcttttattttagctattgtaataagtgtgtagtgatacctcatcgtggtgttattctgcatctagtgaagcaaatgagtgttgaacatcttttcatgtgcttatttgcttatttcctcttcagtgaaatgtatgttcatatcttttcatgattttctaactggattatttgtttgtattttttaccattgaggtttttattatttttttttcttgagacagagtcttgctctgttacccaggctggagtgcagtggcacgatcttggctcactccaacctccgcctcccaggttcaagtgattctcatgcctcagcctccagagtagctgggattacaggcacgcatcatcatgcttgtctaatttttgtatttttagtagagatgggttttttgccatgttgcccaggctggtcttgaactcctggcctcaaggcatctgccctccgtccacctcgacctttcaaagtgctgggattacaaatgtgagccaccacgctcagcctactgttgagttttgagagtactatacatatccattacatattctggatgtgagtcctttcttggatatgtggtttgcaaacattttctttcagatcataccatattttttcatccttctaacaagatttcttgcagagcaaaagttttaaattggatgaaatctaatttattttttccttatgtattatgctttttgaaccattcactatgccctagatctcagacgcttctcctatattttcttgtaaaactttttttttagtttttttgtttgtttgtttgttttttgagatgcattcttgctctgttgcccaggatggagtgcacgatctcggctcactgcaagctccacctcccgggttcacaccattctcctgcctcagcctcccgagtagctgggactacaggcgcctgccacc[137 bp omitted]gcccggccttttatagttttatattttagatttaaatctatgatccacttgacttacttttttgtataaaggtgtgaagattaggcctttttggttttttttttttctttttggcctatggctctgcaactgccccagcatcatttgttaagcagatgatctttccctatttttgtctcttggtaaaaaatcagtgtggggctatttctaggatttctattttgttacagtgatctatgtgtctatttttctcccaataatatatagtcttgattcctgtagctatataagaagtattgaaatatggtagagcaattcctcccaccttattcttctttttcaaaaattgtcttagctatataaatattttttgagatggagtctcacttttgtcgtccaagctggagggcagtggggtgacctcggctcactgcaatctctgtctaccgtgttcaagcggttctcctgtctcagcttcccgagtagctgggatatcaggtgcacgccactacaccggctaatttttgtatttttagtagagacagggtttcgccatgttggccaggctggtttcaaactcctgacctcaagcgatctgcccgtctcagcctcccaaagtgctgggaatacaggtgtgagccaccgggcccagtgttgtcttagctattgacaatttgttacagcagcaatcaaaaatgaatacacttagaaatagattaattagtgaaacaaaataataagtcaagaaacaaactaatttatatacaaacttaagcatgcatttccaaacagtgggcaaaagatgggttgtgtaataaaggattgttgacaagtgtctatccatttggaaaaataaacattaaatccttactttcaaccacataaaataataaattctaaaaattcagagacttaaatgtgaaaacgtgaagtcataaagaactagatgaaattttaggaaaatattacagtgtaagacatcttgagttggcataggcacttcctgatattacaccaaggctataaataatgaatctgacatatttaaagacgtaaaaattaaagtatcatctaagtcaaaagacaccataaaaaactgtttaaaaaggcaaatattaggccaggcacagtggctcatgcctgtaatctcagtactttgggaggccaaggcgggcagatcacgaggtcagcagatcgagaccatcctggctaccacggtgaaaccccgtctctactaaaagtacaaaaaattagccgggtgtggtggtgggcgcctgtagtcccagctgctcgggaggctgaggcaggagaatggtatgaacctggcaggagaatggcatgaacctgggaggtggagcttgcagtgagccgagatcgcaccactgcactccatcctcggcaacagagtgagactccatctcaaaaaaaaaaaaaaaaggcaaattttggggaaaatgaagcatccccaataaattaacagtaaccatctctaatatataacaaagcgtttccatatcaataagagaaactggaacaacccaatgaaaaaatgtgttcaggcatggcactactttatcatatagcagaaaaggattacaaaacagaaattacgaaaggaaaataataaaggaagtggagaagagatccaagaactttcaacgttcatccaatagaagatccagaggtagagaatagaaagactgggatgggcgcggtggctcacgcctgttattccaacactttgggaggccaagggaggcagattacctgaggtcaggagttcgagaccagcctgtccaacatggtgaaaccccgcctctactaaaaatacgaaaattagcccagtgtggtggggggcacctgaaatcccagctacttgggaggctgaggcaggagaatcacttgaacccgggaaacagatgttgcagtgagctgaggtcctgccactgcactccaacctcagtgtcagagcaaaactccatctcaaaaatgaaaaaaaaaaatagactggagagaaggcagtacttgaagaaataatgttctagaattttcccagctgaacaaagacatgaatcttcaacctgaaaagagccacctagttctgagcctgattaacacacatgtgcacacacacctgtgcacgcacgagcgcacacacacacacacaccctcggggtaaaatttctaggataaagataaaatcctgaaaggtcccagagagaaaaagagaagagagaatgcaatggagaggtttttcaaggagctgatttaaaataactttgggccaggcgcagtggctcatgcctgtagtcccagcactttcggcgccaagaccggatgctcgcttgagctcaggagtttgagaccagcctggccaacaaggcgaaacccacttctacaaaaaacacaagtaaccaggtgtggtgccacatgcctgtagtcccagctacttgggaggctgaggcaggagaattgcttgagtccgggaggtggagattgcagtgagccgagattgtgccattgcattccagcctgggtgacagagccaggcactatctcaaaaaaacaaaacaagaacaaacaataaaaaaagttgaacctagatatctatatacagccaggataatccagaatgaggggaaaaatatttcagaaaattcatgacgcatatacccttcagaaataattattggtatacagtcctgtgagaagggaaaactaaatttaggaggaaggaggtgatttcagtaagcaatggtgaggagaaaaatagtaaaatttattgaaaagtgtaaactttagattgaaaaatttaaaaattacagtcttgaactaaaattcccagtattataaacttggaagatgggagcagggacaagaaagaaaagataagctgttttggtgttcaaggaatggatacagatgctaatgaatgatagaatttggtggtgcatgcctgtaacccgagctactcaggaggctggggcagaagaatcacttaaacctgggtggtggaggttgcattgaggtgagatcacaccattgcactccagcctgg[140 bp omitted]gtgaaactccgtctctaccaaaaatacaaaaattagcctggcatagtgtcacacgcctgaggttccagctactcaagaggctgaggcaggagaattgcttggactcgggaggcagaggttcagtgagccaagatcgtgccactgcactccaatctgggcgacagaggaagactctgtctcaaataaataaataaataagtaaatagaaaacctattggatagattggatatgaaaacattaactgctcaaataaataattcagcggaatagattggatgttaaaaccgatatagttgaaaaagcaattactgagctgaggaaatgcatctaaagaattcatgaaagtaatcggtaatggataaagaagaagtaaatgaaagaaaagttaattaatagggaggatagaagaataaatgtcaaaacacatctaatagtagccttataagaagagaatatagtcattaaaaaggagagtgtacttaaataagtaatcaatgagaattcctcagatttaaaaaaatgacttaagatttaaaggtattatagtacacacacacacacacacacacacacaggaaaagtgaaatgtaaaattgtgaaagacaaagaaaaaatattttaaaaatgaacagagagaaatagcaggttacttacagaggaaaaataattaaactgacatcggatctctcaaatactacactggaggcaaggatacaatcgtgtaataattccaaggtgttgaaaaatatgatttttttttgactgagtctcgctttctcacccaggctggagtgcagtggcatgatctcagctcacggcaacctctgcctcctgggatcaagcaaatctcctgcctcagcctcctgagtagctggggctacaggcacacaacaccacacccggctaatttttgtacttttagtagagatgtggtctt[133 bp omitted]aagacaatgtcagccatatgacttcaggagattgaagacacagggaaatgttgaagcaaacaagtatttattgggcttattaaagactgtaaggaagggccagctgcagtggctcatgcctgtaatcccagaactttgggagcctgaagcaacaggattgattgagcccaggagttcaagaccagcctgggcaacatggcaaaaccccgtctctacaaaaaattcaaaaattagacgggcatatcaagttcctgggtctgtagagaatttaaatatatatatatatatacatggctggatttggtggtgcgtacctgtaatcccagctatttggtaggctggggcaggaatattgcttgggccctggaatttcaggctgcagtgagctaggattgggtcactgccctccagcctgagttacagagtgagactttgtctctgaaaataaaaaaaaaaaaagatcgtaaggacgattttactcagaggggggactactgtgataggtacagggaccactgcaatggggtcttgcagtgggagagtgatattgggatcgacttcaactccacaaggacaagtggggatttgtagtcagggagtaggagccgggggtcagaagatgggaaattacttggaggaagcctcaggtgcagggggattctggctaaaccgacttgacaggttttttgctgaaaaaggctaaatgggcagagtccctggatgaaggacagagcctgaggttgagacctagtcagaaacaggactcagaggagcccgattcaagtttggtcaaaggagagtgtctctgtctgaaagcataagcaagaaagccaacagcagtaaaatgaatgggtcacaaaggagaatttttgtgcattgctaagcagggctctgctttaaccattgtgaaagaagtgagtcattcttttttttttttagatgaagtctcgctgtgtcacccaggctggagtgcagtgcgtgatctcggctcactgaaacctcagcttcctgggttgaagcgattctcctgcttcagcctcccgagtagctgggactacagtcacgtgcctcacaccggactaattttgtatttttactagagacagggttttaccatgtcgaccaggctggtctcgaactcctgacctcaagccatctgcccgccttggcctcccaaagtgctgagatttcaggcgtgtgccactgaaacccacctgaattgagtcattttccacatacacaactaggtcagagttgagtggccaggggagaaaccaatcagggcacattgcacctgctccaagaattgaattttccacaaagctggtggctgaaatggcctgctgccaccctaagagcacttttacctagtaactgctgaaacaacctgcaatgactctaaggcttgttttacctattgtccacactcaccaatcagagcttccagctcctgaaagcttctctggtgccaagggacttgctttaaaaactataggtaacatttctgtttctaataaaactctcaactttctcattgttctttggacataccaaagaccagccagtttgtgtgtatgcttcagattacaattctatgattctcaaataaaatgtttagagattcatgggcgtggtggatcacgcctgtaatcccagccgtttgggaggctgaggccggcggatcacttcagcccaggggttcgtgacctgcctgggcaacatggtgaaatcctgtctctacaaaaattacaaaaaattagctggatgtggtggtgcatgcctgtaatcccagttattccagaggctgagtcggggaggcagaggttgcagtgagccgagattgtgccactgcactccggggtggacgacagagtgagaccctgtcttaaaaaacaaaaacaaaaaccataatataacatccttaatattgcgatttaaaaaagagattcatctccataggttttgactttgatatttgtggtgtcagaaatcgggtccgaagctgactcaccttggagatatcaatgacctctggaactatggcgtgaggtctgcacacttggtccccttgagcttttgcttttctggttgcctctttccccccggtgagactttcttggatcaaactgccatttgtcggggagttgagttcagttttatttgggaatttgttaggaagggtctttctctgtctcctggttatgaaacctcctcttttcttttcctttcttttcttgtcttgtcttttttatcttgtctttctcttttctttctttttttttttttttttgagacagtgttttgctctgtcgcacaggctgcagtgcagtggtgtgatctgggctcactgcaaccttcacctcccaggctcaagtgattctcgtgcatcgtcctcccgagtaactgggattacaggtgtgcgccactacgcctggataatttttgtgttttttagtagacatgtggt[131 bp omitted]ttctccctcctggttatgaggccgggttacagagatttttctgttagagaaggcttctcatgcttcctggtaagtttgtactttattttctgagtcgtttgcatgcttagagtttaatttggcttttgtgtattaggcattaaaccgaatcacctagattaatttatttacacacaggctctcaaagttcaaaggcatgccaacatagttccctctttctgggacgccagctggtaatatgtgccaacattacggggatcattcacgcagtctgttttcctcaaactgaactaaaataatacagtccaaatgggactcctatctcagttggtatcttgaggctccagaacacattcaagactcaaaggctgcctcactgcaagatattgtctaaagctagctgagattttcttctccaacaccttcccctctccttcgtttacctcttcctctttatccttctttaagcaaaactctttttccaaaactcctcagctactctggcatactgactattaaaataaagacagttgaaagacatcagatacaaataaaataaaatcactgacctttgtagtgtttcttaaaagcaaaagatgaaattcccatgtaaaagatctccttcctatactaaaaggaaagacaacactcttatcttcaaggatgaggaattgagaccaagagaacattatacaaagcttattggaatacctcttatcttttgggcctcctcacataattcagtcacatttttacagttaacaattctttgtctaattcaacatgttggtaactgactcaaactgctttacccaaaatttgggtcaccaccttcataagattacctattgaggagaaaaatcttaaataaagtttagccttcttccattttgtcagaaatataatttagatccaacgtcttttataaatcggtgagtttgtatggtttactgtcccataatcaaaattctaaaatgaaagttatctttgtttatgtacgtatctgtgtttgggcgtattcctgcgtatgtacatgtgttatgttaaatgtgtctacatggtaaaatccggaatcgttggcaaacaattatttaaagaatcctattcagattggcttaaataggtactcatataaatacacagtaattaactaaaacgcatttagttcatgcaacttaattaagtagttgaaaaataagctggttttaaaattgttggtaaaataaaatgagaaatgttttcaaaattgtgaccacacctttttggctgggtttactggttctatatttgtctctgttggatgtgttaaggttatgaaacataaacctaacctaaaaacagaatggtcttttatgtgcaattctttgataagtaagactaatttaatattgtgagtgtaataaaacagctgtattttctgagttattggcaaaatactcatatatttaaggtttttgctcgggtggatacctgacatttacaggctataataatgttttaataggagaataactccaaatgactagctttatttatttatttatttatttttaaaattttttttagagcagagtctccctctgttgcccaggctggagtgcagtggtgctatctcggctcgctgcaacctctgcctcccagggtcaagagattgtcctgtctcagcctcccaagtagctgggactctaggcgtgcgcccccatgcctggataatttttgtatttttttttttttttttttttgagacggagtctcgctctttcgcccaggccagactgcggtggccctatctcggctcactgcaaactccgcctcctgggttcacaccattctcctgcctcggcctcccgagtagctgggactacaggcgcccgccaccacgcccacctaattttttgtattttagtagagttggggtttcaccttgttggccaggctggtcttcaactcctgacctcaagtgatctgcccttcttggcctccctaagtgctgggattacaggcgtgagccaccgaccccggccgactggctttgtttaatatgtcagttttcataagtaatctaggtataactgttaaaatgaataaatgaggtaactgtgagatacatgtttataagtgaacttttcatgtaatttgaaatgttttttctcttgctcttaccatatggagatgaaatattaaagttgtgttatgttagattaagtaataggtactcactaaatgctgggatcatttccaactaagaaaacaatggatccacctgcctaggcctcccaaaatgctgggattagaggcgtgagccaccatgcccagtgaggaaaagaagtattaaacgctattgttattaaagaaaccaaagatcgtgatgcctggaaggtgattcaaagactcgagataatggacttctggccaagccaacccatggtgacatcatcaggtttgtgcctccactggtgatcaaggaggatgagattcgagagtccagtgaaatcattaacaagaccatcttgtctttctgagggtagcagctgttttcagtggtccctgggagccggctggagacaggtggtcttgtaaaagctctgctctaaatgtaggcacattccactcccatgtgtcttcaaagcctttgtgtggaatatccatttttttcagttgatacacaatagaacaacgtttatgaacctgccttttgcttcctaacgtaagtaagagaatgtaatggcatctatattcagtgaaggtgttttgatgtgcatctgtactttctaaggtaaaacgtatctatgtatacagaacagcctttaaatcacgtccttcagtatactttatatatgtttttataatttccttgctggtataaatgttttgtatttgaaaaagttatctatggagtattacataaaagacttcaccttgtaaagtcaaatcactgttatcattgaattttaggaaggatgaatggttagtcatatgtaaaatactaatattaagtaaacttcatattggcgaacaccagaatgtattctatggttgtcattattttgaattaagaattagtgtttaaaattcctaaattgttttgagtgcttgattataatttgtaaaaaacgtttatttttaatatttctttaaatttaaaataaagcttatatttcagaaaaaaaaaaagatacagaacatggccaggtgcagtggttcacgcctgtaatcccagcacattggtaggccaaggtaggcagatcacttgaggtcaggagttcgagaccagcctgacaagatggtgaaacctcgtctctactaaaaatacaaaagttagccaggcgtggtggcacgtgcctgtatacccagctacatgggagtctgagacaggtgaatggctcaaacctgggaggcagaggttgcagtgagccgagagcctgccactgcattccagcctgggtgacaaagtgagactcagtcttggaataaaaaaaaaaaaaaaaaaggtatagaccattgccatcaccacaatgccatcccttgtgctactcatttttagtaatactcactctcctcctatccaccatccctaacccctgacaaccactaatctatttttcatttctacaattttatcttttctacaatgctgtacaaatgaaatctcatagtatataacattttagaggcttgtttcactcagcataattccctggagattcatccaagatattaatatttgtgtatcaatagttcatatttttgttgttgttgttgttgagatggagtctcactatgtcgcccaggctggagcgcagtggcgtggttttggctcactgcaacctctgcctcccgggtttaagcgattctcgtgcctcagcctcccaagtagctgggactacaggtgcacgccaccatgcccagttgatttttgtattattagtagagacagggtttcaccatattagccaggctggtctcgaactcctgacctcatgatctacttgcctcctgacctcatgatctgcctgcctcggcttcccaaaataccgggattacaagtgtgagccaccgtgcacggccaatggttcatttttattactgagtagtattacatggtatggatgtaccacagtttcaccattcacctattgttggacatattgattatatccggctatttggctattacaaataaagctgctatgaacaattatgtacaagtttctggatggggataaattttaatttctatgaagtggtaattgatgaattgtatggtcactgcatgtttagttttataagaaactaccaaactgctttccagagtggctgtaagattttaccctctcagcagcattttactagatgtccagtttctgtgcatcctttccagcatttcgtattgtcactatgtctttcattttagctgttgtaataagtgtgtagtgatgcctcatcgtggtcttaatttgcatctagtgaagcaagtaagtgttgaacagcctttcatgtgcttatttgcttatttcctcttcagtgaaatgtatgttcatatatcttcataattttctaattgaattatttgtttgtttttaccgttgttttgtttttgagacagagtctcgctctgctaccgaggctggaatgcagtggcatgatcttggctcactccaacctctgcctcctaggttcaagcgattctcatgcctcagcctcccgcgtagctgggattacaggtgcgaaccatcatgcctgtctaatttttgaatgtttagtagagatgggttttgccatgttgcccaggctggtctcgaactcctggcctcaagggatctaccctccgtccacctcgacctcccaaagtgctgggattacaagcgtgagccaccacgcctggcataccgttgagttttgagagtactatacgtatccgttatatattctggatgtgagtcctttcttggatacgtggtttgcaaacattttctcccactttacaccctgttttttcatccttttaacacggtttctacagagcaaaagttaaattggatgaaatctaatttatttttttccttatggattatgctttttgaaccgttcactatgcctagatctcagacgtttctcctactctttcttgtaaaagtttttttagtgttatattttagatttaaatctatgagccacttgagtttttaatatatgtatatatatatgtatatatatatgtgtatatatatgtatatatatgtgtatatatatgtgtatatatatgtatatatatatgtgtatatatatgtatatatatatgtatatatatatgaagattaggtgttttcttgttgttgtttgtttgtttgttgttgttgttgttgttgttgttttgtctatggatatgcaactgctccagcaccatttgttaagcagacgatccttctttttgtctcttggggaaaacagtgtggggcaatttccaggttctctgttttgttccagtgatctatgtgtctattcttctcccaatactacacagtcttgattcctgtagctatataagaagtattgaaatatggtagagccattcctcccaccttattcttctttttcaaaaattgtcttagttacatatacattttttgagaaggagtctcacttttgtcgcccaagctggagggcagtggggtgatctcggctcactgctgtctctgcctcccgtgttcaagcgattctcctgtctcagcttcccaagtagctggaatttcaggtacccgtcaccacacccagctaatttttgtatttttagtagagacggtgtttctccatgttagccaggctggtctcaaactcctgacctcaagcgatccacccatctcggcctcccaaagtgtctttgttcagttcagaaaattctagaacattatttcttcaagtactgccttctccccagtcttaatattcttttttttatttttttcacttttgtgacgtagttttgctctgtcacccagggtgtagtgcagtggcaagacctcagctcactgcaacctccgcttcccaggttcaactgattctcctgcctcagcttcccaagtagctgggatttcagacgcccgccaccacaccgggctaatttttgtatttttagtagacacagggttttgccatgttggacaggctggtctcgaactcctgacctcaggtgatctgcctgcctcagcctcccagagtgctgggattacaggcgtaagccactgcgcccggcccagtctttctattctgtatgtctggaacttctactagatgaacggtgaaacttctgggatctattctccatttcctttattattttactttcatactttctatttcgtaatcgttttctactatacagtgaagtagtgccgtgcctgaagtttttcattgggttgttccaatttctcttatgatatgcaaaagctttgtcgtatattagagatggttacttttactgcggatgcttcaccattttctccaaaatttgcctctttacacagttgtttatggtgtcttttgacttagatgatactttaatttttacatctttaagtatgtcagattcattgttcatagccttggtgtaatgtcaggaagtgcctatgccaactcaaaatgtcttacactgtaatattttcctaaattttcgtctagttctttatgacttcacgttttcacatttaagtcagtgaatttttagaatttattattttatgtggtttaaagtaagtattttaatatttattttttcaaatggatagacacttgtcaagcaatcgtttattatacaacccatcttttgcccagtgtttggaaatgcatgctgaattttgcacataacttagtctgtttcttgactttctattttttttttcactaatctgtttctatatgtattcatttttt[142 bp omitted]gcgaaaccccgtctctactaaaaatacaaaaattagccgggtgtggaggtgcacgcctgtaatgccagctattcgggaagctgagacaggagaatcccttgaacccgggaggcagagtttgcagtgagccgagatcaccccactgccctccagcttgggtgacacgagtgagactccatatcaaaaaaaaattatatagctaagacaatttttgaaaaagaagaataaggtaggaggaatggctctaccatatttcaatacttcttatatagctacaggaatcaagactgtgtagtattggcagaagaatagacacatagatcactggagcaaaatagagaacctagaaatagccacacactgattttttacaaagagacagaaagaaggaaggatcgtctgcttaacaaatggtgctggagcagttgcatatccataggcaaaaaaaaaaaaaaaaaaaaataagacctaatcttcataactttatacaaaaaagtaactcaaatggatcatatatttaaatctgaaatataaaactaaaaaaaaaagcttttacaagaaaacataggagaaacgtctgagatctagggcatggtgaacagttcaaaaagcataatccataaggaaaaaaagtaaattagatttcatccaatttaaaacttttgctctgcaagaaaccctgttaaaaggatgaaaaaacaaagtatggactgggagaaaatgtttgcaaaccacatatccaagaaaggactcacatccagaatatataatggatatgtatagtactctcaaaactcaaccgtaggccgggtgtggtggctcagtcgtgtaatcccagcactttgaaaggtcgaggtggatggaaggcagatcccttgaggccaggagtttgagaccagcctgggcaacatggcaaaaacccatgtctactaaaaatacaaaaattagacaggcatgttgatgcatgcctgtaatcccagctacgcgggaggctgaggcacaagaatcgcttgaacctggaaggcagaggttggagtgagccaagatcatgccactgcactccagcctgggtaacagagagagactctgccttaaataataataataataataataataataataataataataataactcaaaggtaaaaaaaaaccaaataatccaattagaaaattatgaaaagatatgagcatacatttcactgaagaggaaataagcaaataagcacatgaaaagatgttcaacactcatttgcttcactagatgcagaataacaccacgatgaggtatcactacacacttattacaatagctaaaataaaagacatagtgacaacaccaaatggtgacaaggatgcagagaaaatggacacctcattaagtgctgctgggaaggtaaaagcagtttggtagtttcttataaaactaaacatgcagtgaccatacaattcaacaattacacttcagagaagttaaaatgtatgcccatccagaaacttgtacacaattgttcatagcagctttacttgtaatagccaaaagctggaaataatcaatatgtcctgcaataagcgaatggttgaactgtggtacatccataccatggaatactactccgtaataaaaatgaacaattggccggg[136 bp omitted]gtggtggcgggcgcctgtagtcccagctactcagaaggctgagg[165 bp omitted]gctgaggcagtaaaatctcttgaacctgggaggcagaggttgcagtgagccgggatcgcaccactgcactccagcctgggcagcagagtgagactccgtctcaacaacaaaaacaacaatgaactactgatacaaaaatattaatatattggatgaatctccatggaattatgctgagtgaaataagcctgtaaaatgttatatactataagatttcatttgtacagcattgtagaaaagacaaaattgtagaaatgaaaaagattagtagttgccaggggttagggatggtggacgggaggagagtgggtattactaaaaatgagtagcacaagggatagcactttggtgatggaaatgtcctgtaccttttttttttctttctttctttttttttttttttttcccgagagggattttcactctgtcacctaggctggagtgcagtgacacgatctcagctcactgcaacctctgtcttcctggttcaagctattctcctgtctctgcctcccatgtagctgggattacaggtgcgtgccaccatgcctggtaagttttgtatttttagtagagacggggtttctccttgttagccaggctggtctcaaactcctgacctgaagtgatccacccacctcgggctcccaaagtgctgggattacaggcgtgaaccaccgcacctggccatgatctgtatcttatttttttctgaaatataagctttatttaaaatttaaaaaattattaaaaataaacattctttggccaggcgcagtggtggctcatgcctgtaatcccagcactttgggagcccgaggcgggtggatcacgaggccaggagatcgagaccacggtgaaaccccgtctctgctaaaaataaataaaaaaataaaaataaaaataaaaaataaacaaacatttttctacaaattttaatcaagcactcaaagcaattcaggaatgttaaacactaattcttaattgaaaataatgacatccatagaatacatcctggtgttagccaacatgaagtttacttaatattagtattttatatatgcttaaccattcatccttcctaaaattcaatgataacaatgatttgactttataaggtgaagccatttatgtaataccccagagataacattttcaaatacaaaacatttatactagcatggaaattataaaaacatatataaattatactgaaggatgtgatttaaaggctgtcaatacacatagatgcattttaccttagaaagtacacatgcacatcaaaacattcattgaatatagatgccattaaattctcttacttacgttacaaagcaacgggcaggttcataaacgttgttctagtatgtatcaactgcaaaaaacatatattccacgaaaaggttttgaagacacatgggagtggaatgtgcccacatttagagcagagcttttacaggaccacctgtctccagccggctcccagggaccactgaaaacggctgctacactcagaacgacaagatggtcttgttaatgataacaattgaccctggaatctcatcctccttgaccaccagcagaggtgaaacctgatgatgtcgccatgggttggcttggccagaagtccattatctcgaagtcttagacacacactttccaagcagcacaatctttggtttctttaataacaatagcatttaataattcttttccacaccgggtgtggtggctcacacctgtaatcccaacactttggggggcc[134 bp omitted]tgaggcaggagaatcacttgaacccaggaggcagaggttgcagtgagccaagatcgcaccattgcaatccagcctgggcaaccagagtgaacctgtgacttaagcaaataaatacataaataaaataattattttcttcttacaacagttacaacatcagaaggtagcttcatgggttcatttctcaggagaatacccattgtttctgcattttcagcaaggttttcttcttctaaaacttcaagggctgcgatggccacttggcagcctagtggattgccaccgtatgtggacccacgttcccctggcttaatggtcagcattatgttatcattccacagcaccgcagacacagagtatcagcccccagaaagggcctttccaaggaggactatatcaggtctgacattttcatgatcaacagccagccatctaccagttctggccactcctgtctgtatttcatcaacaataaacagaaccaagctgggagcacgagatgggacgagggtaagttaaaataccacaaagcttactgttcttacggagactcagctggttcttttctttctttctttctttctttctttctttctttctttctttctttctttctttctttccttccttccttccttccttccttctttccttccttccttcctccctccctcccttcttcccttcccttccttcttccctttccttcccttccttcttctcttcccttcttcccttcccatcttcccttcctgtcttcccttcccatcttcccttccctttcttcccttccttcttcccttccgttctcccttcccttccttttccttctcctttcgcttcccttctcccttcccttcccttcccttcccttcccttcctttcccttcccttcccttcccttcccttcccttcccttctcctttcccttcccttcccttcccttcccttcccttcccttctcctttcccttcccttctcccttcccttctcccatcccttctcccttcccttccttttcttttcgacagtttttctctgtcacccaggctggagtgcagtggtgggatctcagctcaatgcaacctccccttcccgggttcaaatcattgagtgaacccaggaggttgagaccagcctgggaaacatagcaaaaggcagggtggtgcaggcctgcagtcccgaggccgaggcaggaggatcacttgaacccaggaggtagagaccagcctggacaacatagcgaaactgtctctactagaaaaattaaagatattagtgggggctgggtggtgtgtgccagtggtcccgaggccgaggcaggaggattgcttgagcccaggaggtcaaggccagcctggccaacatagtgaaaccccatttctactaataagaagaacaaccaaaaatagcatgggcggggtggctcacccctgtagttcccaggctgaggtgggaggattgcttgagcccagaaggtcgataccagcctggtcaacatagcgaaagcctgtctctcctaaaaaaaattatcagggcagaatggcacacgcctatggtcccgaggctgaggtggaagcattgcttgagcccaggaggttgaggccagtctgtgcaacatagcaaaacccggtttctactgaaaaacaaaaaaaataccgtgggcagggtggtgcatgcctgtggtccccaggctgaggaggtgggaggatcccttgagccctggaggttgaggccagcctggcctacatagagaaacccagtttcaactaaaaaataataataataataacaaaaacaaacctgggcagggtggtgcatgcctgtagtcccgagaatgagatgggaggattgaccaaggcggatgtaaccaataccacaatcacatcccataagtaaatacattttcctctctccagggctacaggtaaaggatggtaattgtgcgcaccacacttacattcccttccaaaaatgcggcactattcacaatagcaaagacttggaaccaacccaaatgtccaacaatgatagactggattaagaaaatgtggcacatatacaccatggaatactatgcagccataaaaattgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtggggggaggggggagggatagcattgggagatatacccaatgctagatgacgagttagtgggtgcagcgcaccagcgtggcacatgtatacatatgtaactaacctgcacaatgtgcacatgtaccctaaaacttaaagtataataataaaagaaaaaaaaaagaaaactacaaaaaaaaaaaaaaaagaaaaaaaaataagaataaaagaggttggagggccttggactgtttttttagttccaacagatgtagaagccactgaagaatgaactccacgactaagtacagcaaacctccgcaaatgtgctagtttggaaaacattgtgtctttcaaatagaaaaatcacagatcgactattttttcttcccacggttcagactagaatccagatgtttaacccaagatccagggacggtcttcagagagttcaaaatctcctgatggcgcctgaggaccacccactttgtcgcacaaagtgtggctggaggaggcgacaacattctgcaatgtcactgcccaaggatgatggaccaatcagggcagttagtgaactccatctggccaattagaagtcagaacagtaggcggaacaagcgaagctgatgtggcgtctgtcagtccaggctctagggacagaaccttcccaaggcgggggggaggggagactctgattttcccgccgaaagcgtccccttggattggctactttaaattcagagtacgcacacgccgatttgcccttttgattcttccacaatcagggtaagcatgcgctgattttctctttccattcttcctacccctcccctccgccgtggtgcacttcttatctaattttaataatgtatttatgtgaggcaggtcgccatctcaaattcttcctgtcagtttctaactttttcaggtatgggatttttcctaggagctctgtagtaacttaaaaaatctgggctgggcgtggtggctcacgcttgtaatcccagcactttggaggcccacaggtggtggatcgcttgaacccgggaggcggaggttgcagtgagccacgatcgcgccactgcaacacagcctgggcaacagagcgagaccctgtctcaaaaaaaaaaaaaaaaaaaaactcctgggctcaagcgatcctctcgcctcggccccgggactacaggcgtgcaccaccccgcccagagcaccaaaggtcctgaggctggaaagactcaggctgtttctctcgcaggtgagactgctcccagtgccatgaacggagacgacgcctttgcaaggagacccagggatgatgctcaaatatcagagaagttacgaaaggtgaggtgacctggagggggcagagtagtggcccaggggacagtgtggggtgaccaggtttctgaggaggggaggacagaggtactagggacaaggagcagggtctcgggggagatttggacccttgggagcctcccaccctcgctctgtcatcacctagcatccctggagacaagtctctgaccttgcacttcatttggtgactcccactccattctggaaggtgggaagagagccagccagcagcattaaagccctactgtgtggcaggggcgaagctagggaagttccctcatgttctgtcagttagccatggcatcaaccaggacagactatcatccccacttctcagatcccacacacaggaagcggctccagctgaatggcagacatgcctagctgagtccctgccataattcctttttttttttttttccaggccttcgatgatattgccaaatacttctctaagaaagagtgggaaaagatgaaatcctcggagaaaatcgtctatgtgtatatgaagctaaactatgaggtcatgactaaactaggtaacagaaagttctagaagcagacaagtctggggacacatgagcatcccttttcctgttttggctacttcttaggctgcagaaagtaccccacattttccttttgtgcagggaaaaatcacaaggcagcttctgggtgttctcctcttctgtatcctgtcagggctgagggcagggactggccacagtggagctcatacctggatcctgcacgtttctctcccataggcgtcttttctgatgagcccaactgtctctgtggcatcccggcacccccacacccaacacgcacaccctcccttccttctcttggcttgtctctctctctctctctctctttttttttttttaagtcagagtctcactctgtcacctagggaagagtgcagtagtgcaagcatagctcactgcagcctcgaactcctgggctctagcaatcctcctgcccagcctatggagtagctgaggctacaggcacgtgccactatgcccaactaattttattttatattttgtagatatgtgggtctctctatgttgcccaggctagtgttgagcgcctcacctcaagcaatcctccagcctcagcctcccaaagggctggtactacagacatgagccaccgtgccaggcccaagcttgcctcttaagaaataaacattttgctcctttctaggtttcaaggtcaccctcccacctttcatgcgtagtaaacgggctgcagacttccacgggaatgattttggtaacgatcgaaaccacaggaatcagggtgagtagactggaaggggctggaaagggtctcctcaagcccagttgcttttcagctcagctacctgggaaagatcctcaggcatttgttccctcatacacatcggggctgagtgaaaaaaaaaaattgcatgcagaaagttaactacagaggccaatcacataaaattctaaaacatgcaaaacaagaaaatatatttttatggataataagtaaatggtaaatgtatacaaacatgaatgtgaataaaacgccatcaaattaaggtgactggctgtaagtggaggagggagggagggcagggattgctgagtgcggcacagacagcttcagctgtgacttgctgatagtgtgttttgtgttttttgttattgttatttttttttgagacagaatttcactcttgtcacccagcctggagtgcaatagcaaaatctgagctcactgcaacttgcacctcccaggttcaagcgattctcctgcctcagcctcccgagtagctgggattacaggcgctcgcctccacacccaggtaatttttgtatttttggtagagacggggtttcaccatgttggccagtctggcctcaaactacctgacctcaggtgatccactcgcctcagcctcccaaaatgctgggattacaggcgtgagctaccactcctggactgtttatactattgctaatattctgaataaataaatcagatctaagataactgtggggtaatgttgagacccgactgtactcagttttgttccccatacttttctgtgtttttgaaatatttcttttttaaatgacatgttgttcttcctaagcactgttaatgaatcaaaggacatttaagaaaatgtgaaaagtgaaaaaataaaaaaaaagaaaatgttaaaactgtagatccgccaaaaacttccagagtttgtttcattaacagcatgtaggtattggataagtatcttaggagtgagggtgatgaacacattatgtaataagcgtcgctgtttctctgtattttatcaaaaccaaatagtcctcacattccccaacaaccccaattctccgtgatgagcttggaagagagtttgaaagagtgatccctcatccagcacacagagagctttcccacttctcagtgagcagagataacatagggtgaaaaaaagacaagtttcgcgtagagatctttgtgcatttcaggaatataaaggggacatatgtgtttacttgctcttctgctctgagaacacagttacaagacaaggtcagaatgtccagactgtctcccatagacctattacttcccaactaaacaggccagattctacgatctcccacagtcactataagaggtctgaaaatccagtgcttgagtatctgccaagtttttgacattaaatgagtgccaaatatttatactgaaaatatttcagagccactggactaaatcatcgatggttcatcacacagttaacagcttaattgacataccataagattcacccatttgaagtgtacagtgatttttagttgttgcacatcttgagtgattacagtttagattcccaaccaatcaatttaactatttgggaaaaagtaaaagatatgtaatggaaaaagatgagactgtgatggggtttaatacccatgtgataaaccacgagatggaaaattctgaattgatgccacagataaatgcaccaaccatgactaaacataattcagaagcaaatctcaaataactcctcaacaatgagtggactcacaacctctgctgcagaatgccctcatgcgacagaagtctctctagagtttggaaatctttaccaacaaagaaaaattctgatgtattctctttcagttgaacgtcctcagatgactttcggcagcctccagagaatcttcccgaaggtgagtgtctctcaaatctaaaggaccagagaacgtttgtccctgcacggatgcgaacactgataagagtgggagaatatcaaacatgccctcactgcctccttctccccatgtctatcacaacaacttatgtggcaccgacggcttgctaatattaacagttgtgatccttaatacttctttggttttcatagtgatgccagattactattttaagcagttcacatgggttaatttatttaatccttaagaagacctctatgacgatgtttctattactatctccaaatactatcgagccacacacttcaattgtcacccatataaaagacatgtaacttggtgcaaatcttctaagttctctgagatccagactcctggtccatgaaatggaagtaaagaatcatagttcatgttttagatcgtagttatcagcaacataataataaaatgaggctatcggggtacagagatgttaaagaattttcctgaggcacagtggcagtggtagtctaatccagagctccaagccatttaaagctcattcacgtttgcatttgtttatgaagttcagatgttgctcactagggcttcaccccatagggcctcctggtgcttccattgagacacccactctcgcaacaggaaggaccagctggcctctgctctgttaccggggccactcacatggcttaggaatcgctttgactgttggcccctccctactgtgagctccttgatggccttgtgtgcacctggggcatccgggaagcccccgtcccagcccaggggatccctcgaaggcccctgaatgagtgatcccacaactgcagatccaactctggtttggagggtaaagggatctgggagttgggttgccagtgtggagaccaaattcaaagaaggatcatgaaaagtattagttttttattattactacatttaaagagtgtttacaagctcagagagcactttcttgtagcctattttacatgtactgttgactatttcgtaagtgaggaagctgaataaaaagtagcttaagggctgggcgcagtgtctcacgactgtaatcccagcactttgggaggctgaggtgggtggatcacgaggtgaagagatggagaccatcctgcccaacatggtgaaactttgtctctactaaaaatagaaaacttaacggtgcgtgttagagcctacctgtagtcccagctactctggaggctgaggcaggagaatggttgaacctgggagatggaggttacagtgagctgagatcgcgccactgcactcaagcctggcaacagagcaagactccgtgtcaaaaaaaaaaaaaaaaaaggaaaaagaagtagcttaaggtcgttggtcagtgacacatcccaatgcaaccagagttggtatgggtaccacctcacttaattccacattcaatgttggcgcctcggtagggtagtatgccatgtctggtactgctttctttgctgcctagtttaatttcagcaaaccatttctttacctctcctgtccctgtattcatctccccacaccatctttcccagcagtgttttatcgcctctctatgtttttacatttactctcccagcagctgtctacaagcttatatgggatcccttgtattttatagaagctctttcttttctagaccttgtgaattcttagaatgctattctccaaatcttctgtataccaaactctcaattaaatggagatttttgctgtttgcaagaatgtgagtcttaaaagagtgtgaagataagcattctagccctggaaagcccattcgtttaggccattcctttcccttctaacctcccaggtttctcctaatttaggcctgtgtaactctcccagtcttgttgagagcattgaataagctaatgcacgtgaagaccctttgtaagctctaaagcactgtagaaatgtcactgatactgtttatctgcgaccttcacattgtaaagatcatgcccaagaagccagcagaggaagaaaatggtttgaaggaagtgccagaggcatctggcccacaaaatgatgggaaacagctgtgccccccgggaaatccaagtaccttggagaagattaacaagacatctggtaagaggaaagaattcgggaacaacccctctggcttccctggctgtgttcaggtgcgtggactgggtgtgtggcatggaccccagacaagccagggtccaggctgggctgaggagctcgcctagctccagatgagatgttagacatgacttccagagacacagactggagttgtcatccatataaaaaaaaccacgtgacgtggggaaagtcttccaaatttcctcagctccaggttcctagtccataagatggaaataaagaatcatagttcataaattgtttggagacattaaatgtaatctagaaggcctgatgacatgaaaggtgctcaagcaattctatctgtgataacctgggatcatatcttactcagctcaatgcctgttacccaatacaggtgtgcttcagagatattgcaggttcggttccagaccactgcaataaagtgagtcacacacattttttttttgtcttgcagtgcataaaaacattacatttacattatactgcagtctactaagtgtgcaatagcattaagtctgaaaatgcacatacctttattttaaaataattcatcgataaaaaatgctaacaatcttctgagccttcagtgagtcacactctttttgctggtggagggtcttgcctcggtgttgatggctgctggctgatcaaggtggtggttgctgaagattggagtggctgtggcagtttcttaaaagatgacaacaatgaaatttgccacatcaattagctctccctttcatgaaggatttctctgtagtatgtgatgctattggatagcattttacccacagtagaacttctttcaaagttggagtcaatcctctctagctatgaaagtcctagatggcatctccttccaatagaaggctattttatctacattgaaaatctgttgtttcgtgtagccaccttcgtcagtgaccttagccagatcttctggataacttgctgcagcttctccatcagggtttgctgcttcgccttgcacttttatgttatagagacggcttctttccttaaacctcacgaaccaacctctactagcttcacacgtttctcctgcagcttcttcagctctctcagcattcatggacttgaagagagttctggtcttgctctgaattagactttggcttaagggaatgttgtggctggtttcacgttttatcctgaccactcaaactttctctatttgagcagtaaggcagttttgctttcttattcgtgtgttcactggagtattagtattattatttccttcaagaacttttcctttgcattatgtactattatttccttcatgaacttttcctttgcattcacagcttggctgtttggtggaagaggccgagctttcagcctatcttggctttcagcatgcttcctcactaagcttagccatttctagcttctgatttaaagtgagagacatgcgactcttcctttcatttgaacacttagcggccattgtagggttcttaatcgtcctaatttcagtgttgctgtgtctcaggaaatagggaggcccaagaaaaggaggagagatggggaagagctcatcggtggagcagtcagaacacacacaacattaatcgattaagtttgtcatcttctatgggtgcagttcatggtaccccaaaaacaattacatacaacaggatgattatagtcaataataacttaatcgtacatttaaaaaaactaaaagagtgtaaatgaattgtttgtaacacaaggataaatgtttgaggggatggataccctattttccatgatgtgattattacgcattgcatgcgtgtatcaaaacgtctcgcgtaccccataagtatatacacctactgtgtacccactaacataaaaaacaaaaattattttaaaagactaaagagcaacaaaacaattgcaataataatgtcaaagctcactaatgacagatcactataacagatatactaataacggaaaagtataaaattggtgagaattccccccaaaaaattgcagtatctgtgaagcactataaaaatgaggtacaataatacaaggtatgcctgtgtgcccttaacaaatacatgctgaatgaaaggaggtatcggtgaatgttcccgtaagtgaagaggttgggaatttaacctgacaacggaaggagccagaagctaaaattttaatttgcatttggcctgtattggtgtggatctaaggtctcagcctctctaaaccagggaatgtgaaaaactggataaagaaggtccggggcacttgggaggggagaggcatctccttcttttgagaaaacagagcctaacgctctccaatctacccaaccctcattttccaactcttccccatcataggacccaaaagggggaaacatgcctggacccacagactgcgtgagagaaagcagctggtggtttatgaagagatcagcgaccctgaggaagatgacgagtaactccgtaagtgaactttcggaccaccctccacatccttgcagatgtactattctgttatggtactggtatcccatcttatcacttgttccccaaatcattcccttctcataattttctagggtacagcattgaggctgaatgatgagatttcccatgctctttctttctattttttttcctttttgagagggagtcttgctctgtcgcccacgcgggagtgtagtggcgcgatcttggctcactgcaacttgtgcctctcaggttcaagcaattctcctgcctcagcctcctgagtagctgggattacaggtgcacaccaccacaccagggtaatttttgcatttttagtagagacggggtttcaccatgttggtcaggctggacttgaactcctgacctcgtgatccacctgcctcggcctcccaaagtgctgggtttacaggcatgagccaccatgcccggccaatttcccatactctttctactccctgccctgtatatccaaggttgctccctacccaggatgctgtgggttcccaaaccccaggtcagccctgatatgcgggccacaccttcctctagcctaggaattgaaaacccaggcgaagaagtcactgtggcatgaacagatggttcacttcgaggaaccgtggaaggcgtgtgcaggtcctgaggtagggcagaatcacagtgtgcagggtctgcaggtcaggaggagttgagattgagttgtcacgtggtgggaactcactgccacttactttccttctctcttcttgcctcagcctcggggatatgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttggcgtttccgctgtattttcttgcagtgtgccattctgttagacattagcgttttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgattttttcctctgcatttacacacacaccacacacgcacacacacacaccaagtaccagtataagcatctcccatctgcttttctccattgccatgcgacctggtcaagcccccctcactctgtttcctgttcagcatgtactcccctcatccgattccgttgtatcagtcactgacagttaataaacctttgcaaacgttccccagttgtttgcatctctcattattgtgcacacagctctgtgcacgtgtgtgaatatttctttaggaaagattcttagaagtggaattgatgtgtcaaaggagtcatttattcaacaaaaaactaatgagtgtgtactagtgctgagaactgttcgaggtgctggagagacatcagggaacaaggcagacagatgttcctgaccaccattctagaggaagatatttccagtcgttggtattgtttgtttgtttgtttcttctagagatggggtcttgctctgtccaggctagagtgcagtggcacgatcatagcttaatgcagccctgaacttgtgggctcaagggatcctcccacctcagcctccagagaagctgtgactacagccacgcaccatcatgacccactgatttttttaggttttgtcaagaaagtctcgctatattacccaggctggtctccaactcctgggcccaagcaatcctcccaccttggcctcctaaagtgctgggattacaggagtgggccactgcgcctggcctccagtttttattttgatagagactatacacttcagtcctggagcaggattctgcagcaggtggttgggcatctgggcctttgctctctgaatgattttcaagttcaagggctgggacggtccatttgggagtatgtggaaggagacacagatgaaatcgtcatctggggaacgtggaggaatgaggaagatgcgtgcactgtagaccgtgatggacagggaatagaagagtccactcagtctccatgcaggggagcaacggtgggaaagtcccctggacagaagcatgagactgcccatcaagggtctcaccaaccaagggcctgggggctggggtggggacgatgatttcggaaggggccagttctttctcacatgtaccattgcacagtgtggaggggaaacaggtctgcggaaggggagcgcagatgggagtctattttcgaaccaaccattgtgtgtgaatggagacatcaagtcctcccggttctccccagccttggaaggaggacactatcatctttatgcctatatgttagatgagagacggagtcccagccagatggcaggcgtcttgtctgaggtcccacagctggcaggtgcaggaggggctgagtttggagctcactgacttcagaaacattaaggaggacaggtgtgtgtggtggagggagggggaattgaacaagccccgggctctgtccccagtcacaaggtagaggctgtgggttcgttttccaagacaaggagccctaggagagagagagtgcggggagggagaggcagtcgtgatcacagcagggacagtgggagacagagatatgcagggtgggcagaagaggggcaggcaaagaagcaggggagacccaaggccaagtgggggctgccacagccaccagagggagagggtgcctggaaggaggttgtggggctccaggagcagtagaggttccccagatctgtgagcatgccctgcctggcactgcaggaagaggtggctgccacccaggtcagtgtggacgtacctctacctgtgtctcaggggaaacaaattctattttatcccagtatagttctgtattacacaaatgtaacattcggctactagatattgagtgccttatcctccatgcaaatacagcagaggataccctaaaagagatactgaagcttttgatttttctttctccctgggatgatgggatccataagttgggtcccccagcccacaagacaggtgcaaggaagggtggttggaagattgtgagttatgacagggaacattatttcttaggttccttgggtatataaagctccggactatctgtctatcatggataaagagtgaacatggtcccctctccacaaatgtgtttttctcctcgattatcactgtaaagggctgaagttacaccaagttctgatacattactttttcgtgttatttttgagacaggatcacagtctgtcgcccaggctggagtgcagtgatgcaattacagctcactgcagcctcgatctcccaggcttaagggattcacccacttcagcttccgatctagctgggactacaggcacacgccaccgcacccagctagtttttgtatttttttgtagagacggcatccactatgttgcccaggctggtctcgatctcctggcctcaggcaatcctcctgcctcagcctcccaaagtgctgggatgacaagtgtgagccacctcgccaggccttcactttctttaatgaacaattatcagagtttcatcttagaggcaaaagtggctactgccagccaatctgtctgtggtgttggaggggaatctggctgattcagacgtttcagatgaacttttaaattaacctacatgatgattatcctaaggccgtttcctcctccgtgtttttctgattcagggtttggagtttttcagaggctttgttacaaagagcatctcctggtcgggcacagtgactcacgctgtagtgccagcactttgggaggccgaggcaggcagatcacttgatgtcaggagtttgagaccagcctggccaacagggtgaaacccccgtctctactaaaaatacaaaaattagccagccgtggtggcgggctcctgtgaattccagttactgcaggggctgaggcaggagaatcccttgaacctgggagacggagggtgcagtgagctgagatcacgccactgcactccagcctgggcgacagagtaagtctctgtctcaaaaaacaaacaaacagcatctctcgcctacagtgatttgagctgtggtcttgtctccttgggtttctctatcagtctgaccccatctactctatctcccaggaatgcctcaatatttctggtggaccgctgacacgctttcctattttcctctactgttacgaattgacccttgaaaaccttttcttaatttttttaatttttttattactatactttaagttttagggtacatgtgcacaatgtgcagatttgttacatatgtatacatgttccatgttggtgttctgcacccattaacttgtcatttagcattaggtatatctcctaatgctttccctccccctcccccctcccccgtccccgcaccccacaacaggccccggagtgtgatgttccccttcctgtgtccatgtgttctcattgttcaagtcccacctatgagtgagaacatgcggtgtttggttttttgtccttgcaatagtttgctgagaatgatggtttccagtgtcatccatgtccctacaaaggacatgagctcatcattttttatggctacatagtattccatggtgtctatgtgccacattttcttaatccagtctatcattgttggacatttgggttggttccaagtctttgctattgtgaatagtgccgcaataaacatatgtgtgcatgtgtctttatagcagcatgatttataatcctttgggtatatacccagtaatgggatggcagggtcaaatggtatttctagttctagatccctgaggaattgccacactgacttccacaatggttgaactagtttacagtcccaccaacagtgtaaaagtgttcctatttctccacatcctctccagtacttgttgtttcctgacattttaatgattgccattctaactggtgtgagatggtatctcgtggtggttttgatttgcatttctctgatggccagtgatggtgagcattttttcatgtgtcttttggctgcataaatgtcttcttttgagaagtgtctgttcatatctttcgcccactttttgatggggttgtttgtttttttcttgtaaatttgtttgagttcattgtagattctggatattagccctttgtcagatgagtaggttgtgaaaattttctcccattttgtaggctgcctgttcactctgatggtagtttcctttgctgtgcagaagctccttagtttaattagatctcatttgtcaattttggcttttgttgccattgcttttggtgttttagtcatgaagtccttgcccatgcctatgtcctgaatggtattgcctaagttttcttctagggtttttatggttttaggtctaatgttgaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatggttgtagatatgtggcattatttctgagggctctgttctgttcctttgatctatatctctgttttggtaccagtaacaagctgttttggttactgtagccttgtagtatagtttgaagtcaggtagcgtgatgcctccggctttgttcttttggcttaggattgacttggcaatgtgggctcttttttggttccatatgaactttaaagtagttttttccaattctgtgaggaaagtcattggtagcttgatggggatggcattgaattacagagtaaggcaccatgcctggcctctggtaccactttgggattgtatgaaacactatgcttcaaagtgtgggatctggcttcccagacagctgtcaaaggggcagatgatgcaatctagaagtgtgggggagttcatgcctgtggggtaaattttgaccaataagaaaaggaaccaggagtgagagtcagttacataaattgcctctcctctcctctccccctgcaccgttccaggcatggtttctcagtatagtctgcctagatgtttcctgtatggcccaaagcctgtttccttgggaacctgagctaaaacaatgggcatgcaaacacccgaagacagggttaagtgttgtggaggacccagatctgggcagaggaaaattatcccaataaggaaatggacaatttgaggatttgggatagggggaaggactagaagaaccagtagtaatatagcttaggggtactatttttggagaaaaaggcagttctgttgatttttgcagtgaactgcttagctctgtaagatatatacttctttctttccatcagtctctcctgtgaaatctttcataaagtatccttttatagctatctattgcctgtgatgtgaattttcttttttcctttttcttttctttttttttattttttagagttagaattgctgtcgcccaggctggagtgcagtggggtgatctcggctcactgcaatctccacctcctgagttcaagtgatcctcctgcctcagctgccctagtagctaggactacaggcgtgcgccaacaacgcatggctaaattattttttgtatttttagtagagatggggtttcaccatcttggccaggctggtctcaaactcctgacctcaggtgttccaccctcctcagtctcccaaagtgcggaattacaggcgtgagccaccgcacccagcctgtcagttttcttttggagaataaaactgattgagtcttgtgccaaaatgcaggggaggctgcacccagacaggtaacaaaatattatatacagtaatagataggttttctacataccaataataaccatttagaaaaccaaattgagaaaaattacacgtatatagtgacaaaagtacatacaatatctaaaaccagatgattggagcaagatggcagatagatcccgtgccctactcaacattccatcgaactgggaagaaaatattttcaagggtcaattcgtaacagtagaggaaaataggaaagcgtgtcagcggtccaccagaaatattgaggcattcctgggagatagagtagatggggtcagactgatagagaaacccaaggagacaagaccacagctcaaatcactgtaggcgagagatgctgtttgtttgttttttgagacagagacttactctgtcgcccaggctggagtgcagtggcgtgatctcagctcactgcaccctccgtctcccaggttcaagggattctcctgcctcagcccctgcagtaactggaattcacaggagcccgccaccacggctggctaatttttgtatttttagtagagacgggggtttcaccctgttggccaggctggtctcaaactcctgacatcaagtgatctgcctgcctcggcctcccaaagtgctggcactacagcgtgagtcactgtgcccgaccaggagatgctctttgtaacaaagcctctgaaaaactccaaaccctgaatcagaaaaacacggaggaggaaacggccttaggataatcatcatgtaggttaatttaaaagttcatctgaaacgtctgaatcagccagattcccctccaacaccacagacagattggctggcagtagccacttttgcctctaagatgaaactctgataattgttcattaaagaaagtgaaggcctggcgaggtggctcacacttgtcatcccagcactttgggaggctgaggcaggaggattgcctgaggccaggagatcgagaccagcctgggcaacatagtggatgccgtctctacaaaaaaatacaaaaactagctgggtgcggtggcgtgtgcctgtagtcccagctagatcggaagctgaagtgggtgaatcccttaagcctgggagatcgaggctgcagtgagctgtaattgcatcactgcactccagcctgggcgacagactgtgatcctgtctcaaaaataacacgaaaaagtaatgtatcagaacttggtgtaacttcagccctttacagtgataatcgaggagaaaaacacatttgtggagaggggaccatgttcactctttatccatgatagacagatagtccggagctttatatacccaaggaacctaagaaataatgttccctgtcataactcacaatcttccaaccacccttccttgcacctgtcttgtgggctgggggacccaacttatggatcccatcatcccagggagaaagaaaaatcaaaagcttcagtatctcttttagggtatcctctgctgtatttgcatggaggataaggcactcaatatctagtagccgaatgttacatttgtgtaatacagaactatactgggataaaatagaatttgtttcccctgagacacaggtagaggtacgtccacactgacctgggtggcagccacctcttcctgcagtgccaggcagggcatgctcacagatctggggaacctctactgctcctggagccccacaacctccttccaggcaccctctccctctggtggctgtggcagcccccacttggccttgggtctcccctgcttctttgcctgcccctcttctgcccaccctgcatatctctgtctcccactgtccctgctgtgatcacgactgcctctccctccccgcactctctctctcctagggctccttgtcttggaaaacgaacccacagcctctaccttgtgactggggacagagcccggggcttgttcaattccccctccctccaccacacacacctgtcctccttaatgtttctgaagtcagtgagctccaaactcagcccctcctgcacctgccagctgtgggacctcagacaagacgcctgccatctggctgggactccgtctctcatctaacatataggcataaagatgatagtgtcctccttccaaggctggggagaaccgggaggacttgatgtctccattcacacacaatggttggttcgaaaatagactcccatctgcgctccccttccgcagacctgtttcccctccacactgtgcaatggtacatgtgagaaagaactggccccttccgaaatcatcgtccccaccccagcccccaggcccttggttggtgagacccttgatgggcagtctcatgcttctgtccaggggactttcccaccgttgctcccctgcatggagactgagtggactcttctattccctgtccatcacggtctacagtgcacgcatcttcctcattcctccacgttccccagatgacgatttcatctgtgtctccttccacatactcccaaatggaccgtcccagcccttgaacttgaaaatcattcagagagcaaaggcccagatgcccaaccacctgctgcagaatcctgctccaggactgaagtgtatagtctctatcaaaataaaaactggaggccaggcgcagtggcccactcctgtaatcccagcactttaggaggccaaggtgggaggattgcttgggcccaggagttggagaccagcctgggtaatatagcgagactttcttgacaaaacctaaaaaaatcagtgggtcatgatggtgcgtggctgtagtcacagcttctctggaggctgaggtgggaggatcccttgagcccacaagttcagggctgcattaagctatgatcgtgccactgcactctagcctggacagagcaagaccccatctctagaagaaacaaacaaacaaacaataccaacgactggaaatatcttcctctagaatggtggtcaggaacatctgtctgccttgttccctgatgtctctccagcacctcgaacagttctcagcactagtacacactcattagttttttgttgaataaatgactcctttgacacatcaattccacttctaagaatctttcctaaagaaatattcacacacgtgcacagagctgtgtgcacaataatgagagatgcaaacaactggggaacgtttgcaaaggtttattaactgtcagtgactgatacaacggaatcggatgaggggagtacatgctgaacaggaaacagagtgaggggggcttgaccaggtcgcatggcaatggagaaaagcagatgggagatgcttatactggtacttggtgtgtgtgtgtgcgtgtgtggtgtgtgtgtaaatgcagaggaaaaaatcggaaattaaacactcagacctcccctcagtagtcacatctggggagagaggagggtagtgctgttctatggagagaatacctgacaatacttgttttctgaggtaggtgcatggatacacaagccgaaatatgcattaagcatgtcttgctcatcaacgaaaacgctaatgtctaacagaatggcacactgcaagaaaatacagcggaaacgccaacatcgaactcttggcacactaagaaaaatgacgctcaacttttcactgttgtgaacacttgctttcacttgctatgcacctgatgacgaggggtccgcagccatgcccatgttcgtgaaaggtcaccacgttctgcttctcatcatgggcatgtgtcatatccccgaggctgaggcaagaagagagaaggaaagtaagtggcagtgagttcccaccacgtgacaactcaatctcaactcctcctgacctgcagaccctgcacactgtgattctgccctacctcaggacctgcacacgccttccacggttcctcgaagtgaaccatctgttcatgccacagtgacttcttcgcctgggttttcaattcctaggctagaggaaggtgtggcccgcatatcagggctgacctggggtttgggaacccacagcatcctgggtagggagcaaccttggatatacagggcagggagtagaaagagtatgggaaattggccgggcatggtggctcatgcctgtaaacccagcactttgggaggccgaggcaggtggatcacgaggtcaggagttcaagtccagcctgaccaacatggtgaaaccccgtctctactaaaaatgcaaaaattaccctggtgtggtggtgtgcacctgtaatcccagctactcaggaggctgaggcaggagaattgcttgaacctgagaggcacaagttgcagtgagccaagatcgcgccactacactcccgcgtgggcgacagagcaagactccctctcaaaaaggaaaaaaaatagaaagaaagagcatgggaaatctcatcattcagcctcaatgctgtaccctagaaaattatgagaagggaatgatttggggaacaagtgataagatgggataccagtaccataacagaatagtacatctgcaaggatgtggagggtggtccgaaagttcacttacggagttactcgtcatcttcctcagggtcgctgatctcttcataaaccaccagctgctttctctcacgcagtctgtgggtccaggcatgtttcccccttttgggtcctatgatggggaagagttggaaaatgagggttgggtagattggagagcgttaggctctgttttctcaaaagaaggagatgcctctcccctcccaagtgccccggaccttctttatccagtttttcacattccctggtttagagaggctgagaccttagatccacaccaatacaggccaaatgcaaattaaaattttagcttctggctccttccgttgtcaggttaaattcccaacctcttcacttacgggaacattcaccgatacctcctttcattcagcatgtatttgttaagggcacacaggcataccttgtattattgtacctcatttttatagtgcttcacagatactgcaattttttggggggaattctcaccaattttatacttttccgttattagtatatctgttatagtgatctgtcattagtgagctttgacattattattgcaattgttttgttgctctttagtcttttaaaataatttttgttttttatgttagtgggtacacagtaggtgtatatacttatggggtacgcgagacgttttgatacacgcatgcaatgcgtaataatcacatcatggaaaatagggtatccatcccctcaaacatttatccttgtgttacaaacaattcatttacactcttttagtttttttaaatgtacgattaagttattattgactataatcatcctgttgtatgtaattgtttttggggtaccatgaactgcacccatagaagatgacaaacttaatcgattaatgttgtgtgtgttctgactgctccaccgatgagctcttccccatctctcctccttttcttgggcctccctatttcctgagacacagcaacactgaaattaggacgattaagaaccctacaatggccgctaagtgttcaaatgaaaggaagagtcgcatgtctctcactttaaatcagaagctagaaatggctaagcttagtgaggaagcatgctgaaagccaagataggctgaaagctcggcctcttccaccaaacagccaagctgtgaatgcaaaggaaaagttcatgaaggaaataatagtacataatgcaaaggaaaagttcttgaaggaaataataatactaatactccagtgaacacacgaataagaaagcaaaactgccttactgctcaaatagagaaagtttgagtggtcaggataaaacgtgaaaccagccacaacattcccttaagccaaagtctaattcagagcaagaccagaactctcttcaagtccatgaatgctgagagagctgaagaagctgcaggagaaacgtgtgaagctagtagaggttggttcgtgaggtttaaggaaagaagccgtctctataacataaaagtgcaaggcgaagcagcaaaccctgatggagaagctgcagcaagttatccagaagatctggctaaggtcactgacgaaggtggctacacgaaacaacagattttcaatgtagataaaatagccttctattggaaggagatgccatctaggactttcatagctagagaggattgactccaactttgaaagaagttctactgtgggtaaaatgctatccaatagcatcacatactacagagaaatccttcatgaaagggagagctaattgatgtggcaaatttcattgttgtcatcttttaagaaactgccacagccactccaatcttcagcaaccaccaccttgatcagccagcagccatcaacaccgaggcaagaccctccaccagcaaaaagagtgtgactcactgaaggctcagaagattgttagcattttttatcgatgaattattttaaaataaaggtatgtgcattttcagacttaatgctattgcacacttagtagactgcagtataatgtaaatgtaatgtttttatgcactgcaagacaaaaaaaaaatgtgtgtgactcactttattgcagtggtctggaaccgaacctgcaatatctctgaagcacacctgtattgggtaacaggcattgagctgagtaagatatgatcccaggttatcacagatagaattgcttgagcacctttcatgtcatcaggccttctagattacatttaatgtctccaaacaatttatgaactatgattctttatttccatcttatggactaggaacctggagctgaggaaatttggaagactttccccacgtcacgtggttttttttatatggatgacaactccagtctgtgtctctggaagtcatgtctaacatctcatctggagctaggcgagctcctcagcccagcctggaccctggcttgtctggggtccatgccacacacccagtccacgcacctgaacacagccagggaagccagaggggttgttcccgaattctttcctcttaccagatgtcttgttaatcttctccaaggtacttggatttcccggggggcacagctgtttcccatcattttgtgggccagatgcctctggcacttccttcaaaccattttcttcctctgctggcttcttgggcatgatctttacaatgtgaaggtcgcagataaacagtatcagtgacatttctacagtgctttagagcttacaaagggtcttcacgtgcattagcttattcaatgctctcaacaagactgggagagttacacaggcctaaattaggagaaacctgggaggttagaagggaaaggaatggcctaaacgaatgggctttccagggctagaatgcttatcttcacactcttttaagactcacattcttgcaaacagcaaaaatctccatttaattgagagtttggtatacagaagatttggagaatagcattctaagaattcacaaggtctagaaaagaaagagcttctataaaatacaagggatcccatataagcttgtagacagctgctgggagagtaaatgtaaaaacatagagaggcgataaaacactgctgggaaagatggtgtggggagatgaatacagggacaggagaggtaaagaaatggtttgctgaaattaaactaggcagcaaagaaagcagtaccagacatggcatactaccctaccgaggcgccaacattgaatgtggaattaagtgaggtggtacccataccaactctggttgcattgggatgtgtcactgaccaacgaccttaagctacttctttttcctttttttttttttttttttgacacggagtcttgctctgttgccaggcttgagtgcagtggcgcgatctcagctcactgtaacctccatctcccaggttcaaccattctcctgcctcagcctccagagtagctgggactacaggtaggctctaacacgcaccgttaagttttctatttttagtagagacaaagtttcaccatgttgggcaggatggtctccatctcttcacctcgtgatccacccacctcagcctcccaaagtgctgggattacagtcgtgagacactgcgcccagcccttaagctactttttattcagcttcctcacttacgaaatagtcaacagtacatgtaaaataggctacaagaaagtgctctctgagcttgtaaacactctttaaatgtagtaataataaaaaactaatacttttcatgatccttctttgaatttggtctccacactggcaacccaactcccagatccctttaccctccaaaccagagttggatctgcagttgtgggatcactcattcaggggccttcgagggatcccctgggctgggacgggggcttcccggatgccccaggtgcacacaaggccatcaaggagctcacagtagggaggggccaacagtcaaagcgattcctaagccatgtgagtggccccggtaacagagcagaggccagctggtccttcctgttgcgagagtgggtgtctcaatggaagcaccaggaggccctatggggtgaagccctagtgagcaacatctgaacttcataaacaaatgcaaacgtgaatgagctttaaatggcttggagctctggattagactaccactgccactgtgcctcaggaaaattctttaacatctctgtaccccgatagcctcattttattattatgttgctgataactacgatctaaaacatgaactatgattctttacttccatttcatggaccaggagtctggatctcagagaacttagaagatttgcaccaagttacatgtcttttatatgggtgacaattgaagtgtgtggctcgatagtatttggagatagtaatagaaacatcgtcatagaggtcttcttaaggattaaataaattaacccatgtgaactgcttaaaatagtaatctggcatcactatgaaaaccaaagaagtattaaggatcacaactgttaatattagcaagccgtcggtgccacataagttgttgtgatagacatggggagaaggaggcagtgagggcatgtttgatattctcccactcttatcagtgttcgcatccgtgcagggacaaacgttctctggtcctttagatttgagagacactcaccttcgggaagattctctggaggctgccgaaagtcatctgaggacgttcaactgaaagagaatacatcagaatttttctttgttggtaaagatttccaaactctagagagacttctgtcgcatgagggcattctgcagcagaggttgtgagtccactcattgttgaggagttatttgagatttgcttctgaattatgtttagtcatggttggtgcatttatctgtggcatcaattcagaattttccatctcgtggtttatcacatgggtattaaaccccatcacagtctcatctttttccattacatatcttttactttttcccaaatagttaaattgattggttgggaatctaaactgtaatcactcaagatgtgcaacaactaaaaatcactgtacacttcaaatgggtgaatcttatggtatgtcaattaagctgttaactgtgtgatgaaccatcgatgatttagtccagtggctctgaaatattttcagtataaatatttggcactcatttaatgtcaaaaacttggcagatactcaagcactggattttcagacctcttatagtgactgtgggagatcgtagaatctggcctgtttagttgggaagtaataggtctatgggagacagtctggacattctgaccttgtcttgtaactgtgttctcagagcagaagagcaagtaaacacatatgtcccctttatattcctgaaatgcacaaagatctctacgcgaaacttgtctttttttcaccctatgttatctctgctcactgagaagtgggaaagctctctgtgtgctggatgagggatcactctttcaaactctcttccaagctcatcacggagaattggggttgttggggaatgtgaggactatttggttttgataaaatacagagaaacagcgacgcttattacataatgtgttcatcaccctcactcctaagatacttatccaatacctacatgctgttaatgaaacaaactctggaagtttttggcggatctacagttttaacattttcttttttttttattttttcacttttcacattttcttaaatgtcctttgattcattaacagtgcttaggaagaacaacatgtcatttaaaaaagaaatatttcaaaaacacagaaaagtatggggaacaaaactgagtacagtcgggtctcaacattaccccacagttatcttagatctgatttatttattcagaatattagcaatagtataaacagtccaggagtggtagctcacgcctgtaatcccagcattttgggaggctgaggcgagtggatcacctgaggtcaggtagtttgaggccagactggccaacatggtgaaaccccgtctctaccaaaaatacaaaaattacctgggtgtggaggcgagcgcctgtaatcccagctactcgggaggctgaggcaggagaatcgcttgaacctgggaggtgcaagttgcagtgagctcagattttgctattgcactccaggctgggtgacaagagtgaaattctgtctcaaaaaaaaataacaataacaaaaaacacaaaacacactatcagcaagtcacagctgaagctgtctgtgccgcactcagcaatccctgccctccctccctcctccacttacagccagtcaccttaatttgatggcgttttattcacattcatgtttgtatacatttaccatttacttattatccataaaaatatattttcttgttttgcatgttttagaattttatgtgattggcctctgtagttaactttctgcatgcaattttttttttcactcagccccgatgtgtatgagggaacaaatgcctgaggatctttcccaggtagctgagctgaaaagcaactgggcttgaggagaccctttccagccccttccagtctactcaccctgattcctgtggtttcgatcgttaccaaaatcattcccgtggaagtctgcagcccgtttactacgcatgaaaggtgggagggtgaccttgaaacctagaaaggagcaaaatgtttatttcttaagaggcaagcttgggcctggcacggtggctcatgtctgtagtaccagccctttgggaggctgaggctggaggattgcttgaggtgaggcgctcaacactagcctgggcaacatagagagacccacatatctacaaaatataaaataaaattagttgggcatagtggcacgtgcctgtagcctcagctactccataggctgggcaggaggattgctagagcccaggagttcgaggctgcagtgagctatgcttgcactactgcactcttccctaggtgacagagtgagactctgacttaaaaaaaaaaaaagagagagagagagagagagacaagccaagagaaggaagggagggtgtgcgtgttgggtgtgggggtgccgggatgccacagagacagttgggctcatcagaaaagacgcctatgggagagaaacgtgcaggatccaggtatgagctccactgtggccagtccctgccctcagccctgacaggatacagaagaggagaacacccagaagctgccttgtgatttttccctgcacaaaaggaaaatgtggggtactttctgcagcctaagaagtagccaaaacaggaaaagggatgctcatgtgtccccagacttgtctgcttctagaactttctgttacctagtttagtcatgacctcatagtttagcttcatatacacatagacgattttctccgaggatttcatcttttcccactctttcttagagaagtatttggcaatatcatcgaaggcctggaaaaaaaaaaaaaaggaattatggcagggactcagctaggcatgtctgccattcagctggagccgcttcctgtgtgtgggatctgagaagtggggatgatagtctgtcctggttgatgccatggctaactgacagaacatgagggaacttccctagcttcgcccctgccacacagtagggctttaatgctgctggctggctctcttcccaccttccagaatggagtgggagtcaccaaatgaagtgcaaggtcagagacttgtctccagggatgctaggtgatgacagagcgagggtgggaggctcccaagggtccaaatctcccccgagaccctgctccttgtccctagtacctctgtcctcccctcctcagaaacctggtcaccccacactgtcccctgggccactactctgccccctccaggtcacctcacctttcgtaacttctctgatatttgagcatcatccctgggtctccttgcaaaggcgtcgtctccgttcatggcactgggagcagtctcacctgcgagagaaacagcctgagtctttccagcctcaggacctttggtgctctgggcggggtggtg[131 bp omitted]ctgcaacctccgcctcccgggttcaagcgatccaccacctgtgggcctccaaagtgctgggattacaagcgtgagccaccacgcccagcccagattttttaagttactacagagctcctaggaaaaatcccatacctgaaaaagttagaaactgacaggaagaatttgagatggcgacctgcctcacataaatacattattaaaattagataagaagtgcaccacggcggaggggaggggtaggaagaatggaaagagaaaatcagcgcatgcttaccctgattgtggaagaatcaaaagggcaaatcggcgtgtgcgtactctgaatttaaagtagccaatccaaggggacgctttcggcgggaaaatcagagtctcccctcccccccgccttgggaaggttctgtccctagagcctggactgacagacgccacatcagcttcccttgttccgcctactgttctgacttctaattggccagatggagttcactaactgccctgattggtccatcatccttgggcagtgacattgcagaatgttgtcgcctcctccagccacactttgtgcgacaaagtgggtggtcctcaggcgccatcaggagattttgaactctctgaagaccgtccctggatcttgggttaaacatctggattctagtctgaaccgtgggaagaaaaaatagtcgatctgtgatttttctatttgaaagacacaatgttttccaaactagcacatttgcggaggtttgctgtacttagtcgtggagttcattcttcagtggcttctacatctgttggaactaaaaaaacagtccaaggccctccaacctcttttattcttatttttttttcttttttttttttttttgtagttttcttttttttttcttttattattatactttaagttttagggtacatgtgcacattgtgcaggttagttacatatgtatacatgtgccacgctggtgcgctgcacccactaactcgtcatctagcattgggtatatctcccaatgctatccctcccccctccccccaccccacaacagtccccagagtgtgatgttccccttcctgtgtccatgtgatctcattgttcaattcccacctatgagtgagaatattcggtgtttggttttttgttcttgcgatagtttactgagaatgatgatttccaatttcatccatgtccctacaaaggacatgaactcatcaatttttatggctgcatagtattccatggtgtatatgtgccacattttcttaatccagtctatcattgttggacatttgggttggttccaagtctttgctattgtgaatagtgccgcatttttggaagggaatgtaagtgtggtgcgcacaattaccatcctttacctgtagccctggagagaggaaaatgtatttacttatgggatgtgattgtggtattggttacatccgccttggtcaatcctcccatctcattctcgggactacaggcatgcaccaccctgcccaggtttgtttttgttattattattattattttttagttgaaactgggtttctctatgtaggccaggctggcctcaacctccagggctcaagggatcctcccgcctcctcagcctggggaccacaggcatgcaccaccctgcccacggtattttttttgtttttcagtagaaaccgggttttgctatgttgcacagactggcctcaacctcctgggctcaagcaatgcttccacctcagcctcgggaccataggcgtgtgccattctgccctgataattttttttaggagagacaggctttcgctatgttgaccaggctggtatcgaccttctgggctcaagcaatcctcccacctcagcctgggaactacaggggtgagccaccccgcccatgctatttttggttgttcttcttattagtagaaatggggtttcactatgttggccaggctggccttgacctcctgggctcaagcaatcctcctgcctcagcctcgggaccactggcacacaccacccagcccccactaatatctttaatttttctagtagagacagtttcgctatgttgtccaggctggtctctacctcctgggttcaagtgatcctcctgcctcggcctcgggactgcaggcctgcaccaccctgccttttgctatgtttcccaggctggtctcaacctcctgggttcactcaatgatttgaacccgggaaggggaggttgcattgagctgagatcccaccactgcactccagcctgggtgacagagaaaaactgtcgaaaagaaaaggaagggaagggagaagggatgggagaagggaagggagaagggaagggaaaggagaagggaagggaagggaagggaagggaagggaagggaagggaagggaagggaagggaagggaaaggagaagggaagggaagggaagggaagggaaaggaagggaagggaagggaagggaagggaagggagaagggaagcgaaaggagaaggaaaaggaagggaagggagaacggaagggaagaaggaagggaagaaagggaagggaagatgggaagggaagacaggaagggaagatgggaagggaagaagggaagagaagaaggaagggaaggaaagggaagaaggaagggaagggaagaagggagggagggaggaaggaaggaaggaaagaaggaaggaaggaaggaaggaaggaaagaaagaaagaaagaaagaaagaaagaaagaaagaaagaaagaaagaaagaaagaaagaaagaaagaaagaaaagaaccagctgagtctccgtaagaacagtaagctttgtggtattttaacttaccctcgtcccatctcgtgctcccagcttggttctgtttattgttgatgaaatacagacaggagtggccagaactggtagatggctggctgttgatcatgaaaatgttaggcctgatatagtcctccttggaaaggccctttctgggggctgatactctgtgtctgcggtgctgtggaatgataacataatgctgaccattaagccaggggaacgtgggtccacatacggtggcaatccactaggctgccaagtggccatcgcagcccttgaagttttagaagaagaaaaccttgctgaaaatgcagaaacaatgggtattctcctgagaaatgaacccatgaagctaccttctgatgttgtaactgttgtaagaagaaaataattattttatttatgtatttatttgcttaagtcacaggttcactctggttgcccaggctggattgcaatggtgcgatcttggctcactgcaacctctgcctcctgggttcaagtgattctcctgcctca[134 bp omitted]ggccccccaaagtgttgggattacaggtgtgagccaccacacccggtgtggaaaagaattattaaatgctattgttattaaagaaaccaaagattgtgctgcttggaaagtgtgtgtctaagacttcgagataatggacttctggccaagccaacccatggcgacatcatcaggtttcacctctgctggtggtcaaggaggatgagattccagggtcaattgttatcattaacaagaccatcttgtcgttctgagtgtagcagccgttttcagtggtccctgggagccggctggagacaggtggtcctgtaaaagctctgctctaaatgtgggcacattccactcccatgtgtcttcaaaaccttttcgtggaatatatgttttttgcagttgatacatactagaacaacgtttatgaacctgcccgttgctttgtaacgtaagtaagagaatttaatggcatctatattcaatgaatgttttgatgtgcatgtgtactttctaaggtaaaatgcatctatgtgtattgacagcctttaaatcacatccttcagtataatttatatatgtttttataatttccatgctagtataaatgttttgtatttgaaaatgttatctctggggtattacataaatggcttcaccttataaagtcaaatcattgttatcattgaattttaggaaggatgaatggttaagcatatataaaatactaatattaagtaaacttcatgttggctaacaccaggatgtattctatggatgtcattattttcaattaagaattagtgtttaacattcctgaattgctttgagtgcttgattaaaatttgtagaaaaatgtttgtttattttttatttttatttttatttttttatttatttttagcagagacggggtttcaccgtggtctcgatctcctgacctcgtgatccgcccgcctcggcctcccaaagtgttgggattacatgcgtgagccactgcgcccggccaattgttcatttttattacggagtagtattccatggtatggatgtaccacagttcaaccattcgcttattgcaggacatattgattatttccagcttttggctattacaagtaaagctgctatgaacaattgtgtacaagtttctggatgggcatacattttaacttctctgaagtgtaattgttgaattgtatggtcactgcatgtttagttttataagaaactaccaaactgcttttaccttcccagcagcacttaatgaggtgtccattttctctgcatccttgtcaccatttggtgttgtcactatgtcttttattttagctattgtaataagtgtgtagtgatacctcatcgtggtgttattctgcatctagtgaagcaaatgagtgttgaacatcttttcatgtgcttatttgcttatttcctcttcagtgaaatgtatgctcatatcttttcataattttctaattggattatttggtttttttttacctttgagttattattattattattattattattattattattattattttttaaggcagagtctctctctgttacccaggctggagtgcagtggcatgatcttggctcactccaacctctgccttccaggttcaagcgattcttgtgcctcagcctcccgcgtagctgggattacaggcatgcatcaacatgcctgtctaatttttgtatttttagtagacatgggtttttgccatgttgcccaggctggtctcaaactcctggcctcaagggatctgccttccatccacctcgacctttcaaagtgctgggattacacgactgagccaccacacccggcctacggttgagttttgagagtactatacatatccattatatattctggatgtgagtcctttcttggatatgtggtttgcaaacattttctcccagtccatactttgttttttcatccttttaacagggtttcttgcagagcaaaagttttaaattggatgaaatctaatttactttttttccttatggattatgctttttgaactgttcaccatgccctagatctcagacgtttctcctatgttttcttgtaaaagcttttttttttagttttatatttcagatttaaatatatgatccatttgagttacttttttgtataaagttatgaagattaggtcttattttttttttttttttttttttgcctatggatatgcaactgctccagcaccatttgttaagcagacgatccttccttctttctgtctctttgtaaaaaatcagtgtgtggctatttctaggttctctattttgctccagtgatctatgtgtctattcttctgccaatactacacagtcttgattcctgtagctatataagaagtattgaaatatggtagagccattcctcctaccttattcttctttttcaaaaattgtcttagctatataatttttttttgatatggagtctcactcgtgtcacccaagctggagggcagtggggtgatctcggctcactgcaaactctgcctcccgggttcaagggattctcctgtctcagcttcccgaatagctggcattacaggcgtgcacctccacacccggctaatttttgtatttttagtagagacggggtttcgc[142 bp omitted]aaaaaatgaatacatatagaaacagattagtgaaaaaaaaaaatagaaagtcaagaaacagactaagttatgtgcaaaattcagcatgcatttccaaacactgggcaaaagatgggttgtataataaacgattgcttgacaagtgtctatccatttgaaaaaataaatattaaaatacttactttaaaccacataaaataataaattctaaaaattcactgacttaaatgtgaaaacgtgaagtcataaagaactagacgaaaatttaggaaaatattacagtgtaagacattttgagttggcataggcacttcctgacattacaccaaggctatgaacaatgaatctgacatacttaaagatgtaaaaattaaagtatcatctaagtcaaaagacaccataaacaactgtgtaaagaggcaaattttggagaaaatggtgaagcatccgcagtaaaagtaaccatctctaatatacgacaaagcttttgcatatcataagagaaattggaacaacccaatgaaaaacttcaggcacggcactacttcactgtatagtagaaaacgattacgaaatagaaagtatgaaagtaaaataataaaggaaatggagaatagatcccagaagtttcaccgttcatctagtagaagttccagacatacagaatagaaagactgggccgggcgcagtggcttacgcctgtaatcccagcactctgggaggctgaggcaggcagatcacctgaggtcaggagttcgagaccagcctgtccaacatggcaaaaccctgtgtctactaaaaatacaaaaattagcccggtgtggtggcgggcgtctgaaatcccagctacttgggaagctgaggcaggagaatcagttgaacctgggaagcggaggttgcagtgagctgaggtcttgccactgcactacaccctgggtgacagagcaaaactacgtcacaaaagtgaaaaaaataaaaaaaagaatattaagactggggagaaggcagtacttgaagaaataatgttctagaattttctgaactgaacaaagacactttgggaggccgagatgggtggatcgcttgaggtcaggagtttgagaccagcctggctaacatggagaaacaccgtctctactaaaaatacaaaaattagctgggtgtggtgacgggtacctgaaattccagctacttgggaagctgagacaggagaatcgcttgaacacgggaggcagagacagcagtgagccgagatcaccccactgccctccagcttgggcgacaaaagtgagactccttctcaaaaaatgtatatgtaactaagacaatttttgaaaaagaagaataaggtgggaggaatggctctaccatatttcaatacttcttatatagctacaggaatcaagactgtgtagtattgggagaagaatagacacatagatcactggaacaaaacagagaacctggaaattgccccacactgattttccccaagagacaaaaagaaggatcgtctgcttaacaaatggtgctggagcagttgcatatccatagacaaaacaacaacaacaacaacaacaacaaacaaacaaacaacaacaagaaaacacctaatcttcatatatatatacatatatatatacatatatatacacatatatatatacatatatatacacatatatatacacatatatatacatatatatacacatatatatatacatatatatacacatatatatatacatatatatatacatatattaaaaactcaagtggctcatagatttaaatctaaaatataacactaaaaaaacttttacaagaaagagtaggagaaacgtctgagatctaggcatagtgaacggttcaaaaagcataatccataaggaaaaaaataaattagatttcatccaatttaacttttgctctgtagaaaccgtgttaaaaggatgaaaaaacagggtgtaaagtgggagaaaatgtttgcaaaccatgtatccaagaaaggactcacatccagaatatataacggatacgtatagtactctcaaaactcaacggtatgccaggcgtggtggctcacgcttgtaatcccagcactttgggaggtcgaggtggacggagggtagatcccttgaggccaggagttcgagaccagcctgggcaacatggcaaaacccatctctactaaacattcaaaaattagacaggcatgatggttcgcacctgtaatcccagctacgcgggaggctgaggcatgagaatcgcttgaacctaggaggcagaggttggagtgagccaagatcatgccactgcattccagcctcggtagcagagcgagactctgtctcaaaaacaaaacaacggtaaaaacaaacaaacaaataattcaattagaaaattatgaagatatatgaacatacatttcactgaagaggaaataagcaaataagcacatgaaaggctgttcaacacttacttgcttcactagatgcaaattaagaccacgatgaggcatcactacacacttattacaacagctaaaatgaaagacatagtgacaatacgaaatgctggaaaggatgcacagaaactggacatctagtaaaatgctgctgagagggtaaaatcttacagccactctggaaagcagtttggtagtttcttataaaactaaacatgcagtgaccatacaattcatcaattaccacttcatagaaattaaaatttatccccatccagaaacttgtacataattgttcatagcagctttatttgtaatagccaaatagccggatataatcaatatgtccaacaataggtgaatggtgaaactgtggtacatccataccatgtaatactactcagtaataaaaatgaaccattggccgtgcgcggtggctcacacttgtaatcccggtattttgggaagccgaggcaggcagatcatgaggtcaggaggcaagtagatcatgaggtcaggagttcgagaccagcctggctaatatggtgaaaccctgtctctactaataatacaaaaatcaactgggcatggtggcgtgcacctgtagtcccagctacttgggaggctgaggcacgagaatcgcttaaacccgggaggcagaggttgcagtgagccaaaaccacgccactgcgctccagcctgggcgacatagtgagactccatctcaacaacaacaacaacaaaaatatgaactattgatacacaaatattaatatcttggatgaatctccagggaattatgctgagtgaaacaagcctctaaaatgttatatactatgagatttcatttgtacagcattgtagaaaagataaaattgtagaaatgaaaaatagattagtggttgtcaggggttagggatggtggataggaggagagtgagtattactaaaaatgagtagcacaagggatggcattgtggtgatggcaatggtctataccttttttttttttttttattccaagactgagtctcactttgtcacccaggctggaatgcagtggcaggctctcggctcactgcaacctctgcctcccaggtttgagccattcacctgtctcagactcccatgtagctgggtatacaggcacgtgccaccacgcctggctaacttttgtatttttagtagagacgaggtttcaccatcttgtcaggctggtctcgaactcctgacctcaagtgatctgcctaccttggcctaccaatgtgctgggattacaggcgtgaaccactgcacctggccatgttctgtatctttttttttttttctgaaatataagctttattttaaatttaaagaaatattaaaaataaacgttttttacaaattataatcaagcactcaaaacaatttaggaattttaaacactaattcttaattcaaaataatgacaaccatagaatacattctggtgttcgccaatatgaagtttacttaatattagtattttacatatgactaaccattcatccttcctaaaattcaatgataacagtgatttgactttacaaggtgaagtcttttatgtaatactccatagataactttttcaaatacaaaacatttataccagcaaggaaattataaaaacatatataaagtatactgaaggacgtgatttaaaggctgttctgtatacatagatacgttttaccttagaaagtacagatgcacatcaaaacaccttcactgaatatagatgccattacattctcttacttacgttaggaagcaaaaggcaggttcataaacgttgttctattgtgtatcaactgaaaaaaatggatattccacacaaaggctttgaagacacatgggagtggaatgtgcctacatttagagcagagcttttacaagaccacctgtctccagccggctcccagggaccactgaaaacagctgctaccctcagaaagacaagatggtcttgttaatgatttcactggactctcgaatctcatcctccttgatcaccagtggaggcacaaacctgatgatgtcaccatgggttggcttggccagaagtccattatctcgagtctttgaatcaccttccaggcatcacgatctttggtttctttaataacaatagcgtttaatacttcttttcctcactgggcatggtggctcacgcctctaatcccagcattttgggaggcctaggcaggtggatccattgttttcttagttggaaatgatcccagcatttagtgagtacctattacttaatctaacataacacaactttaatatttcatctccatatggtaagagcaagagaaaaaacatttcaaattacatgaaaagttcacttataaacatgtatctcacagttacctcatttattcattttaacagttatacctagattacttatgaaaactgacatattaaacaaagccagtcggccggggtcggtggctcacgcctgtaatcccagcacttagggaggccaagaagggcagatcacttgaggtcaggagttgaagaacagcctggccaacaaggtgaaaccccaactctactaaaatacaaaaaattaggtgggcgtggtggcgggcgcctgtagtcccagctactcgggaggccgaggcaggagaatggtgtgaacccaggaggcggagtttgcagtgagccgagatagggccaccgcagtctggcctgggcgaaagagcgagactccgtctcaaaaaaaaaaaaaaaaaaaaatacaaaaattatccaggcatgggggcgcacgcctagagtcccagctacttgggaggctgagacaggacaatctcttgaccctgggaggcagaggttgcagcgagccgagatagcaccactgcactccagcctgggcaacagagggagactctgctctaaaaaaaattttaaaaataaataaataaataaataaagctagtcatttggagttattctcctattaaaacattattatagcctgtaaatgtcaggtatccacccgagcaaaaaccttaaatatatgagtattttgccaataactcagaaaatacagctgttttattacactcacaatattaaattagtcttacttatcaaagaattgcacataaaagaccattctgtttttaggttaggtttatgtttcataaccttaacacatccaacagagacaaatatagaaccagtaaacccagccaaaaaggtgtggtcacaattttgaaaacatttctcattttattttaccaacaattttaaaaccagcttatttttcaactacttaattaagttgcatgaactaaatgcgttttagttaattactgtgtatttatatgagtacctatttaagccaatctgaataggattctttaaataattgtttgccaacgattccggattttaccatgtagacacatttaacataacacatgtacatacgcaggaatacgcccaaacacagatacgtacataaacaaagataactttcattttagaattttgattatgggacagtaaaccatacaaactcaccgatttataaaagacgttggatctaaattatatttctgacaaaatggaagaaggctaaactttatttaagatttttctcctcaataggtaatcttatgaaggtggtgacccaaattttgggtaaagcagtttgagtcagttaccaacatgttgaattagacaaagaattgttaactgtaaaaatgtgactgaattatgtgaggaggcccaaaagataagaggtattccaataagctttgtataatgttctcttggtctcaattcctcatccttgaagataagagtgttgtctttccttttagtataggaaggagatcttttacatgggaatttcatcttttgcttttaagaaacactacaaaggtcagtgattttattttatttgtatctgatgtctttcaactgtctttattttaatagtcagtatgccagagtagctgaggagttttggaaaaagagttttgcttaaagaaggataaagaggaagaggtaaacgaaggagaggggaaggtgttggagaagaaaatctcagctagctttagacaatatcttgcagtgaggcagcctttgagtcttgaatgtgttctggagcctcaagataccaactgagataggagtcccatttggactgtattattttagttcagtttgaggaaaacagactgcgtgaatgatccccgtaatgttggcacatattaccagctggcgtcccagaaagagggaactatgttggcatgcctttgaactttgagagcctgtgtgtaaataaattaatctaggtgattcggtttaatgcctaatacacaaaagccaaattaaactctaagcatgcaaacgactcagaaaataaagtacaaacttaccaggaagcatgagaagccttctctaacagaaaaatctctgtaacccggcctcata[145 bp omitted]accacatgtctactaaaaaacacaaaaattatccaggcgtagtggcgcacacctgtaatcccagttactcgggaggacgatgcacgagaatcacttgagcctgggaggtgaaggttgcagtgagcccagatcacaccactgcactgcagcctgtgcgacagagcaaaacactgtctcaaaaaaaaaaaaaaaaaaagaaagaaaagagaaagacaagataaaaaagacaagacaagaaaagaaaggaaaagaaaagaggaggtttcataaccaggagacagagaaagacccttcctaacaaattcccaaataaaactgaactcaactccccgacaaatggcagtttgatccaagaaagtctcaccggggggaaagaggcaaccagaaaagcaaaagctcaaggggaccaagtgtgcagacctcacgccatagttccagaggtcattgatatctccaaggtgagtcagcttcggacccgatttctgacaccacaaatatcaaagtcaaaacctatggagatgaatctcttttttaaatcgcaatattaaggatgttatattatggtttttgtttttgttttttaagacagggtctcactctgtcgcccaccccggagtgcagtggcacaatctcggctcactgcaacctctgcctccccgactcagcctctggaataactgggattacaggcatgcaccaccacatccagctaattttttgtaatttttgtagagacaggatttcaccatgttgcccaggcaggtcacgaacccctgggctgaagtgatccgccggcctcagcctcccaaacggctgggattacaggcgtgatccaccacgcccatgaatctctaaacattttatttgagaatcatagaattgtaatctgaagcatacacacaaactggctggtctttggtatgtccaaagaacaacgagaaagttgagagttttattagaaacagaaatgttacctatagtttttaaagcaagtcccttggcaccagagaagctttcaggagctggaagctctgattggtgagtgtggacaataggtaaaacaagccttagagtcattgcaggttgtttcagcagttactaggtaaaagtgctcttagggtggcagcaggccatttcagccaccagctttgtggaaaattcaattcttggagcaggtgcaatgtgccctgattggtttctcccctggccactcaactctgacctagttgtgtatgtggaaaatgactcaattcaggtgggtttcagtggcacacgcctgaaatctcagcactttgggaggccaaggcgggcagatggcttgaggtcaggagttcgagaccagcctggtcgacatggtaaaaccctgtctctagtaaaaatacaaaattagtccggtgtgaggcacgtggctgtagtcccagctgctcgggaggctgaagcaggagaatcgcttcaacccaggaagctgaggtttcagtgagccgagatcacgcactgcactccagcctgggtgacacagcgagacttcatctaaaaaaaaaaaagaatgactcacttctttcacaatggttaaagcagagccctgcttagcaatgcacaaaaattctcctttgtgacccattcattttactgctgttggctttcttgcttatgctttcagacagagacactctcctttgaccaaacttgaatcgggctcctctgagtcctgtttctgactaggtctcaacctcaggctctgtccttcatccagggactctgcccatttagcctttttcagcaaaaaacctgtcaagtcggtttagccagaatccccctgcacctgaggcttcctccaagtaatttcccatcttctgacccccggctcctactccctgactacaaatccccacttgtccttgtggagttgaagtcgatcccaatatcactctcccactgcaagaccccattgcagtggtccctgtacctatcacagtagtcccccctctgagtaaaatcgtccttacgatctttttttttttttattttcagagacaaagtctcactctgtaactcaggctggagggcagtgacccaatcctagctcactgcagcctgaaattccagggcccaagcaatcttcctgccccagcctcccaagtagctggaactacaggtacgcaccaccacacccaggtatttttttttttcagttctctacagacgcaggaacttgatgtgcccggcggatttttctattttttgtagagacagggtttcaccatgttgcccaagctggtcttgaactcctgggctcaaccaatcctcttgcctcgggcacccaaagttctgggattacaggcatgagccactgcagctgacccttccttacagtctttaataagtgcaataaatacttgtttgctttaacatttccctgtgtcttcaatctcctgaagtcttacatgcttgacattgtattttcctctgtaagtaacctgctatttctctccgatcattttaaaatattttttccttgtctttcacaattttacatttcactgttcctgtgtgtgtactataatacctttaaatcttaagtcatttttttaaatctgaggaattctcattgattacttatttaagtacactctcctttttaatgactatattctcttcttataaggctactattagatgtgttttgacatttattcttctatcctccctattaattaacttttctttcatttacttcttctctatccattaccgattactttcatgaattctttagacgcatttcctcagctcagtaattgctttttcaactctatcagttttaatatccaatctattccaccaaataatttatttgagcagttaatgttttcatatccaatctatccaatagtttttctttttatttatttatttatttattcatttattcgtttgagatagagtcttgctctgtcacccaggctggagtgcagtggcaccatcttggctcactgaacctctgcctcccgagtccaagcaattctcctgcctcagcctcttgagtagctggaaccacaggcatgtgacactatgccaggttaatttttgtatttttagtacagacggggttgcaccttg[147 bp omitted]tggagtgcaatggtgtgatctcggctcactgcaacctccgcctcccaggttcaagtgattctcctgccccagcctcctgagtagctggagttacaggtgtgcaccaccacgcccaactacttttatatttttagtagagatggggtttcaccatgttggccaggctggtcttaaactgctgacctcaggtgatcctcccaccacagccttccaaaatgctgggattataggtgtgagccaccctgcctgggctgtcagatagtttttctatataaccctttcttcctgggaagatgtgtaagcccagacactccatgtgagttttagggtttctggattgataggtcgtaggatagggagcctctagagctgagctgagccaattctttccagtccctagcctatgagcccccagagacccttacaggatttctgccttacagcgtggagggggtctacgggtgagtgataccggttgtaattgcgtagctcagagggcagagggagaagtaggaaaggaatgctcagttactgaccagctttgatgagtctgcactttttctaggagctttccaagccccttattctttaatgttatcaggccactttgggctagcactgggccagccctgccaagtttctgctctgtatgtttacagaacaggtaataagccttctagaaaataaggagaaaaaaagaatgcaacttagaaagctccgcctgggctgattctccatctgtggcctctgacctttcccactctaagccatctcatcccccagtggggctaaaccatcaagggttttgttactgggaactgttctgaactccaaccacttcccacctcttctgtggcatctgcagggttgggtttgggaaagaagccagcagctattcctggttcaccatcttcttcttgaaccagatatgcctttacattttaaaagtaatttgaagtcattactaacaacacctaaaagatatatactaacttaaccacatgacaggcgctattctaagtgctttacacgtacttacccatttaatcatagcaatcaagtgagttagatagtgtggttatccccagtttactcttgagtagcctgaaacacggaaaggttatatgagttacacaaggtcacataccttaataagttgagaagccagaaactgaacccaagctgtctggctccagagtttgcactctaaaatactagcgttaagtgggcacagtgactcactcctataatcccaccactttgagaggctgaggtgggaggattgcttgaggataagagttcaagatcatcctgggcaacataggaaaacactctctctaccaaaaaaacaaatttttaattagccagccttggtggtgcacgcctgtagtcccagctacatgggaggttgagacaggaggatcacttgagctgaagaggctggggctacagtgagccatgattgtgctatggaactctagcctgggcaacagagtgaggccgtctctaaaataaaacaaaataaaatgctaatgcttttagccactctaccattctatcattcattagtgtcggtatccattccttgaacaacaaaagaacttctctttttttttcctgtccctcgtcccatcttccatgtttataatactgggaattttatttcaagactataattttttaagtttacaatcaaaagtttacactgtttaataaattttactatttttcttctaacaattgcttattgaaatcaccttcctcttaaatttacttttcttttctcatagggctgtataccaataattatttctgaagggtatatgtgtcattaattttctgaactattttttccctcattgtggattatcctggctgtatacagatatctaggttcaactttttttgtttgtttgtttttgttttgttttgttgttctgagacagtgcctggctctgtcacccaggctggaatgcagtggcaccatctcagctcatggcaatctccacctcctggactcagagattctcctgcctcagccttccaagtagctgggactgcaggcacgtggcaccacacctagctacttgttgtattttttgtacagatgggtttcgccgtgttggccaggctggtctcaaactcctgagctcaagcaatcctcccgtctcagcttcccaaagtgctgagactacaggcgtgagctactgcacctggcccaaacttatttttaatcagctccttgaaaaacttctccattgcattctctcttctctctttctctctgggacctttcaggattttatctctatcctagaaattttactccaagggtgtgtgtgtgtgtgcgtgcacgcaggtgtgtgtgcacatgtgtgttaggctcagaactagatggctcttttcagtttgaagattcatgtctttgttcagttcagaaaattctagaatgttatttctttaagtagtgccttctctccagtctttctattgttttgttgttgttgttgttactttttttttcatttttgacggagttttgctgtgacacccaggttgaagtacagcggcaggacctcagctcactgcaacctccgcttcctgggttcaagtgattcttctgcctcagcctcccacatggctgagatttcaggcacctaccaccacacctggctaatttttgtatttttagtagagacagggtttcaccatgttggacatgttttagatcatagttatcagcagcataataataaaatgaggctatcattgtacagagatgttaaagaattttcctggggcacagtggcagtggtagtctaatccagagctccaagccatttaaagctcattcacgtttgcatttgtttatgaagttcagatgttgctcactagggcttcaccccatagggcctcctggtgcttccgttgagacacccactctcgcaacaggaaggaccagctggcctctgctctgttaccggggccactcacatggcttaggaatcgctttgactgttggcccctccctactgtgagctccttgatggccttgtgtgcacctggggcatctgagaagccccagtcccagcccaggggatcctcggaggcccctgaatgagtgaccccacaagtgcagattcaactctggtttagagggtaaagggatctgggattgggttgccagtatggaggccaaattcaaagaaggatcatgaaaggtattaattgttattattactacacataaacagtgtttacaagctcagagaggactttcccttagcctattttacatgtattattcactatttcataagtgaggaagctgaataaaaagtagcttaagggccgggcgcggtgtctcacaactgtaatcccagcactttgggaggctgaggtgggcagatcacgaggtcaagagatcgagaccatcctgcccaacatggtgaaacctcgtctctactaaaaatacaaaacttagcctggcgtggcagcacctgcctgtagtcccaggtactctggagactgaggcagaagaatcacttaaatacaggagtcggatgttgcagtgagccaagatcgtgccactgcactccagcctggcgacagagcaagactccatctcaaaaaagaagaaaaaaaaaaaaaaactagcttaagattgttggtcagtgacatatcccaatgcaaccagaattggtatgggtaccatctcacttaattccacattcaatgttgatgcctcggtagggtggtatgccagatctggtactgctttctttgctgcctagtttaatttcagcaaaccatttctttacctctcccatccctgtattcatctccccacaccatctttccccacagtgttttctcccctccctatgtttttacatttattctcccagcagctgtctacaagcttatatgggatcccacaaaacgatgggaaacagctgtgcccccaggaaaaccaagtacccctgagaagattaacaagacatctggtaagagcaaacagtttgggaacaacccctctggcttccctggctatgttcaggtgtgtggactgggtgtgtggcatggaccccagacaagcctgggtccagcctgggctgaggagcttgctcagctccagatgagatgttagacttgacttccagagacacagggtggagttgtcatccatataaaaaaccacgtgacaggggagaggttccaagatggccaaataggaacagctccagtctagagctcccagcatgaatgacgcatttctgcatttccaacagaggtaccgggttcatctcattgggaatggttggaccgtgggtgcagcccatggagtatgacccgaagcagggcggggtatcgcctcaccggggaagtgcaaggggttggggaattccctttcctagccaagggaagccgtgacagatggcacctggaaaatcgggacactcccgccctaatactgtgcttttccagtggtcttagcaaacggcacaccaggagagtatatcctgcgcctggctcggagtgacccatgcccacggagcctcactcactgctagcacagcagtctgagatcgaactgcaaggcggcagtgaagctgggggaggggcgcccgccattgctgaggcttgagtaggtaaacaaagtggccaggaagcttgaactgggtggagcccaccgcagctcaaggaagcctgcctgcctctgtagactccacctctgggggcagggcatagcggaacaaaaggcagcagaaacttctgcagacttaagcgtccctgtctgacagctttgaagagagtagtggttctcctagcacagagtttgagatctgagaacagtcagactgcctcctcaagtgggtctttgatccccgagtagcctaactgggagacacctcccagtaggggccaactgacacctcatacagctgggtgcccctctgagacgaagcttccagaggaaggatcaggctgcaacatttgctgttctgcaatatttgctgttctgcagcctctgctggtgatacccaggaaaacagggtctggagtggacctccagcaaactccaacagacctgcagctgagggtcctgactgttagaatgaaaactaacaaacagaaaggacaaccacaccaaaaccccatctgtacatcaccatcaaaaaagaccaaaggtagataaaaccacaaagatgggaagaaaccagagcagaaaaactgaaaattctaaaaaccagagtgcctcttctcctccaaaggaacgcagctccttgccagcaacggaacaaagctggatggagactttgatgagttgagagaagaaggcttcagacaatcggtaataacaaacctctctgagctaaaggaggatgttcaaactcatcgcaaagaagctaaaaaccttgaaaaaacattagacgaatggctaactagaataaacagcatagagaagaccttaaatgatatgatggagctgtaaaccacagcacgagaactacgtgatgcatgcagaagcctcaggagccaattcgatcaagtggaagaaagggtatcagtgattgaagatcaaatgaatgaaatgaagtgagaagagaaggttagagaaaaaagagtaaaaagaaatgaacaaagcctccaagaaatatgggactatgtgaaaagaccaaatctatgtctgattggtatacctgaaagtgacagggagaatggaaccaagttggaaaacactctgcaggatattatccaggagaacttctccaacctagcaaggcaggccagcattcaaattcagaaaacacagagaacaccacaaagatactcctcgagaagagcaactccaagacacataattgtcagattcaccaaagttgaaatgaaagaaaaaatgttaagggcagccagagagaaaggtcaggttacccacaaagggaagcccatcagactaacagcggatctctcggcagaaactctacaagccagaagagagtgggggccaatattcaacattcttaaagaaaagaattttcaacccagaatttcatatccagccaaactaaccttcataagcaaaaggagaaataaaatcctttacagacaaacaaatgctgagagattttgtcaccaccaggcctgccttataagaactcctgaaggaagcactaaacatggaaaggaacaaccagtaccagccactgcaaaaacatgccaaagtgtaaagaccatcgatgctaggaagaaactgcatcaactaacgagcaaaataaccagctaacatcataatgacaggatcgaattcacacataacaatattaaccttaaatgtaaatgggctaaatgctccaattaaaagacacagactggcaaattggataaagagtcaagacccatcagtgtgctgtattcaggagacccatttcacttgcagagacacacataggctcaaaataaagggatggaggaagatctaccaagcaaatggaaaacaaaaaaaggcaggggttgcaatcctagtctctgataaaaaagactttaaaccaacaaagatcaaaagagacaaagaaggctattacataatggtaaagggatcaattcaacaagaagagctaactatcctaaatatatatgcatccaatacaggagcacccagattcataaagcaagtccttagagacctacgaagagacttagactcccacacaataataatgggagactttaacaccccactgtcaacattagacagatcaatgagacggaaagttaacaaggatatccagaaattgaactcagctctgcaccaagtggacctaatagacatctacagaactctccaccccacatcaacagaatatacattcttctccgcaccacattgaacttttgccgaaattgaccacatagttggaagtaaagcactcctcagcaaatgtaaaagaacagaaattataacaaactgtctctcagaccacactgcaatcaaactagaactcaggattaagaaactcactcaaaaccgctcaattacatggaaactgaacaacctgctcctgaatgactactgggtacataacgaaatgaaggcagaaataaagatgttctttgaaaccaatgagaacaaagatacaacataccagaatctctggaacacatataaagcagtgtgtaaagggaaatttatagcactaaatgctcacaagagaaagcaggaaagatctaaaattgacaccctaacatcacaattaaaagaactagagaagcaagagcaaacacattcaaaagctagcagaaggcaagaaataactaagatcagagcagaactgaaggagttagagacacaaaaaagccttcaaaaaatcaatgaacccaggagcttgttttttgaaaagatcaacaaaattgatagaccgctagcaagactaataaagaagaaaagagagaagaatcaaacagacgcaataaaaaatgagaaaggggatatcaccaccgatcccacagaaatacaaactaccatcagagaatactataaacacctctatgcaaataaactagaaaatctagaagaaatggataaattcctggacacatacaccctcccaaggctaaaccaggaagaagttgaatccctgaatagaccaataacaggctctgaaattcaggcaataattaatagcctagcaaccaaaaaaagtccaggaccagatggattcacagccaaattctaccagaggtacaaagaggagctggtaccattccttctgaaactattccaatcaatagaaaaagagggaatcctccctaacttattttatgaggccagcatcatcctgataccaaagcctggcagagacacaacaaaaaaagaacattttagacccatagccctgatgaacatcgatgcaaaaatcctcaataacatactggcaaaccgaatccagcagcacatcaaaaagcttatccaccatgctcaaattggcttcatccctgggatgcaaggctggttcaacatatgcaaatcaataaacgtaatccatcacataaacagaaccaaagacaaaaaccaaataattatctcactagatgtagaaaaggccttcaacaaaattcaacagcctttcatgctaaaaactctcaataaactaggtattgatgggatgtatctcaaaataataagagctatttatgacaaacccacagccaatatcatactgaatgggcaaaaactggaagcattccctttgaaaactggcacaaaacacggatgctctctctcaccactcctattcaacatagtattggaagttctggccagggcaatcaggcaagagaaagaaataaagggtattcaattaggaaaagaggaagtcaaattgtccctgtttgcagatgacatgattgtatatctagaaaaccccatcatctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaaggaatgtgaaggacctcttcaaggagaactacaaaccactgctcaatgaaataaaagaggacacaaacaaatggaagaacattccatgctaatggataggaagaatcaatatcgtgaaaatggccatactgcccaaggtaatttatagattcaatgccatccttatcaagctaccaatgactttcctcacagaattggaaaaaactactttaaagttcatgtggaaccaaaaaatagcctgcattgccaagacaatcctaagccaaaagaacaaagctggagacatcatgctacctaacttcaaactatactacaaggctatagtaaccaaaacagcatggtactggtaccaaaacagagatatagaccaatggaacagaacagagtcctcagaaataatgccacatatctacaaccatctgatctttgacaaacctgacaaaaacaaacaatggggaaaggattccctatttaataaatggtgctgggaaaactggctagccatatgtagaaagctgaaactggatcccttccttacaccttatacaaaaattaattcaagatggattaaagacttcaacgttagacctaaaaccataaaaaccctagaagaaaacctaggcaataccattcaggacacaggcattggcaaggacttcaagactaaaacaccaaaagcaatggcaacaaaagccaaaattgacaaatgggatctaattaaactaaagagcttctgcacagcaaaagaaactgccatcagagtgaataggcaacctacagattaggagaaaatttttgcaatctacccatctgacacttttacactgttggtgggactgtaaactagttcaaccattgtggaagccagtgtggggattcctcaaggatctagaactagaaacatcatttgacccagccatcccattactgggtatatacccaaaggactataaatcatgctgctataaagacacatgcacacatatgtttgttgcggcactattcacaatagcaaagacttggaaccaacccaaatgtccatcaatgatagactggattaagaaaatgtggcacatctacaccatggaatactatgcagccataagaaaggatgagttcatgtcctttgtagggacatggatgaagctggaaaccatcattctgagcaaactatcgcaaggacagaaaaccaaacacctcatattctcactcataggtgggaattgaacaatgagaacacttggacacagggtggggaacatcacacactggtgcctgtcatggggtcgggggaggggggagggatagcattaggagatatacctaatgtaaatgacgagttaatgggtgcagcacaccaacatggcacatgtatatatatgtaacaaacctgcacgttgtgaccatgtaccctagaacttaaagtgtaatttaaaaaaaaaacatgtgacttggggcaagtctcccaaatttcctcagctgcagattcctagtccataagatggaaataaagaatcatagttcataaattgtttggaagcattaaatttaatctagaaggcctgatgacatgaaaggtgctcaagcaattctatctgtgataacctgggatcatatcttactcagctcaatgcctgatacccaatacacgtgtacttcagagatattgcaggttcagttccagaccactgcaataaagtgagtcacacacattgttttttgtttgacagtgcataaaacattatgtttacgctacagtgtagtctactaagtgtgcaatagtgttatgtctaaaaatatatataccttaattttaaaataattcattgtcaataatgctaacaatcttctgagccttcagtgagtcacactctttttgctggtggaggatcttgccttggtgttgatggctgctggcttatcaaggtggtggttgctgaagggtggagtggctgtggcagtttcataaaagaagacaacaatgaaatttgccacatcaattagctctccctttcatgaaggatttctctgtagtatgtgatgctattggatagcattttacccacagtagaacttctttcaaagttggagtcaatcctctctagctatgaaagtcctagatggcatctccttccaatagaaggttattttatctacattgaaaatctgttgtttcgtgtagccaccttcatcagtgaccttagctagatcttctggataacttgctgcagcttctccatcagggtttgctgcttcgccttgcatttttatgttatagagacggcttctttccttaaacctcacgaaccaacctctactagcttcacacgtttcttctgcagcttcttcaactctctcagctttcatggacttgaagagagttctggtcttgctctgaattagactttggcttaagggaatgttgtggctggtgtcatgttttatcctgaccactcaaactttctctatttgagcagtaaggcagttttgctttcttattcgtgtgttcactggagtattagtattattatttccttcaagaacttttcctttacattatatactattatttccttcaagaacttttcctttgcattcacagcttggctgtttggtgcaagcggcctagctttcatcctgtcttggctttcagcatgcttcctcactaagcttagccatttctagcttctgatttaaagtgagagacatgtgactcctcctttcatttgaacacttagcggccattgtagggttcttaatcgtcctaatttcagtgttgctgtgtctcaggaaatagggaggcccaagaaaaggaggagagatggggaagagctcatcggtggagcagtcagaacacacacaacattaatcgattaagtttgtcatcttctatgggtgcagttcatggtacccccaaaacaattacacataacagggtgattatagtcaataataacttaattgtgtgtttaaaaagaactgatagaatgtaattggattgtttgtaacacaaggataaatggctgaggggatggataccctattttccacgatgtgattactacgcatttgcatgcctgtatcaaaacatctcacgtaccccataagaatatacacctactgcgtacccacaaaataaagaacaaaaattattttaaaagactaaaaaacaacaaaaacaattgcagtaataatgtcaaagctcactgatcacagatcaccataacagacataataataatggaaaagtataaaattggtgagaatttccaaaaaaaattgcagcatctgtgaagcactgtaaaaatgaggagcaataaaacaaagtgtgcctgtgtgcccttaacaaatgcttgctgaatgaaaggaggtatcggtgaatgttcccgtaagtgaagaggttgggaatctaaacctcacaatggaaggagccagaagctaaaattttagtttgcatttggcctgtattggtgtggatctaaggtctcagcctctctaagccagagaatgtgaaaaactggataaagaaggcccatgggcacttgggagggggtaggcatctccttttttggagaaaacagagcctaacactctccaacctacccaaccctcatcttccaactattcatcataggacccaaaaggcggaaacatgactggacccacagactgcgtgagagaaagcagctggtgatttatgaagagatcagcgaccctgaggaagatgacgagtaactccataagtgaatcttcggctcacccctcacatccctgcagatgtgctattctgttatgatactggtatcccatcttctcacttgttccccaaaccattcccttctcataattttctagggtacagcattgaggctgaatgatgagatttcccatgctctttcgtattttttttttttttgagatggagtctctctttgtcacccaggtgcgatctcggctcactgcaagctccacctcctgggttcacgccattctgcctc[175 bp omitted]gcccggccgatttcgcattctctttttactccctggcctgtaggtccagggatgctccctacccaggatgctgtgggctcccaaaccccaggtcagccctgatatgcaggccgcaccttcctctagcctaggaattgatagcctaggcgaggaagtcactgtggcatgaacagatggttcacttcgaggaaccgtggaaggtgtgtgcaggtcctgagatagggcagaatcggagtgggcagggtctgcaggtcaggaggagttgagattgagttgtcacgtggtgggaactcactgccacttactttccttccctcttcttgcctcagcctcagggaatatgacacatgcccatgatgagaagcagaacgtggtgacctttcacgaacatgggcatggctgcggacccctcgtcatcaggtgcatagcaagtgaaagcaagtgttcacaacagtgaaaagttgagcatcatttttcttagtgtgccaagagttcgatattggcgtttccgttgtattttcttgcagtgtgccattctgttagacattagcgttttcttttgatgagcaagacatgcttaatgcatatttcggcttgtgtatccatgcacctacctcagaaaacaagtattgtcaggtattctctccatagaacagcactaccctcctctctccccagatgtgactactgagatcaggtctgagtgtttaatttctgattttttcctctgcatttacacacacacctcacatgcacacacacacaccgagtaccagtataagtatctcccatctgcttttctccattgccacgtgtcctggtcaagcccccctcactctgtttcctgttcagcatgtactcccctcatccaattcccctgtatcagtcactgccagttaataaacctttgcaaacgttccccagttgtttgctcctctcattattgtccacacagctctgtgcacgtgtgtgaatatttctttaggaaagattcttagaagtggaattgatgtgtcaaaggagtcatttattcaacaaaaccctaatgagtgtgtcctcgtgctgagcgctattctaggtgctggagagacatcagggaacaaggcagacagatgttcctgaccaccattctagaggaggatgtttccagttgctgggtgtttgtttgtttcttctagagattgggtcgtgctctgtccaggctggagtgcagtggcatgatcatagctcaatgcagccttgaactcctgggctcaagcgatcctccctcttcagcctccggagtagctgtgactacaggcatgcaccatcacaccccactaacttttttaggtttgtcaagaaagtctcgctatgttacccaggctggtctcaaactcctgggctcaagcgatcctcccgccttggcctcctaaaatgcagggattacaggggtgagctgctgtgcctggcctccagtttttattttgatagagactatacacttcagtcctggagcaggattctgcagcatgtggttgggcatcttggccttcgctctctgaaccatttttgggttcaaggtctgggatggtccatttgggagtatgtgggaggagacacagatgaaatcgtcatctgggtaacgtggaggaatcaggcagatgtgtgcactgtagactctgtgatggccagggaatagaagagtccacttagtctccatgcaggggagcaacggtgggaaagtcccctggacagaagcatgagactgcccatcaagggtctcaccaaccaagggcctgggggctggggtggggacagtgatttgggaatgggacagttctttctcataggtaccattgcacggtgcagaggggaacatttctggggaagggaaaggcagaggggagtctattttaaaatcattgtgtgtgaatggagaccattaagactcacacctataatcccagcactttgggaggccaagactagcagatcacttgaggtcaggagttcaagaccagtctggccaacatggagaaaccacgtctccactaaaaatataaaaattagccgggtgtggtggctcacgcctgaaattccaggtactcaggaggctgaggcaggagaatcgcttgaatccaggaggcagaggttgcagtgaggcgagattaccccagtgcactccagcttgggcgacacaagtgagactccatctcaaaaatatatatacatatgcatatatatatatagctaagacactttttgaaaaagaagaataaggtgggaggaatggctctaccatatttcaatacttcttatatagctacaggaatcaagactgtgtcgtatggggcgaagaatagacacacagatcactggaacaaaatagagaacctagaaatagccccacactgactttttacaaagcgacaaaaagaaggaaggattgtctgctcaacaaatggtgctggagaagttgcagagccataagctaataaaaaaaagacctaatcttcatacctttatacaaaaaaaaaaaaactcaagtggatcatagatttaaatctaaaatataaaactaaaacagaaacttttacaagaaaacataggagaaacatctgagatctagggcatagtaaacagttcaaaaagcataatccataaggaaaaaaaattagatttcatccaatttaaaacttttgccctgcaagaaaccctgttaaaaggatgaaaaaacagggtatggaatgggagagaatgtttgcaaaccacatatccaagaaaggactcacatccagaatgtataatggatatgtatagtactctcaaaactcaacagtaggccatggctcacgcttgtaatcccagcactttgaaaggttgaggtggatggagggcagatcccttgagggcaggagtttgagatcagcctgagcaacatggcaaaaacccatctctactaaaaatacaaaaattgacaggcatgatggttcacgcctgtaatcccagctacttgggaggctgaggcatgagaatcgcttgaacctgggaggcggaggttggagtgagccaagatcatgccactgcactccagcctgagtaacagagcgagaggctctctcaaaaacaaacaacaacaacaaaaaactcaacggcaaaaaacaaacaaataatccaattagaaaatgatcaaaatatatgaacatacatttcactgaagaggaaataagcaaataagctcatgaaaagatgttcaacactaatttgcttcactagatgcaaattaagaccatgatgaggtatcactacacacttattacaacagctaaaataaaagacatagtgacaacacgaaatggtgacaaagatgcagagaaattggacaccttgtaaaatgctgctgggaaggtaaaatcttacagccactatggaaaactgtttgatagtgtcttataaaactaaacatgcaatgagcacacaattcaacaattacacttcagagaaattaaaatttatgcccatccagaaacttatacataattgttcatagcagctttacttgtaatcgccagaagctcgaaataatcaatatgtccaacaataagtgaatggtcaaactgtggtacatccataccacgaattactactcaccaataaaaatgaactattgatacataaatattaatgccttgaatgaatctccagggaattatgctgagtgaaataagcccctaaaatgttatatactataagatttcatttgcacagcattgtagaaaagacaaaattgtagaaatgaaaaacagatttgtggttgccagggattagggatggtggatgggaggacagtattaccaaaaatgagtagcacaagggatagcattgtggtgatgaaaatggtttgtaacttttttttgagacagagtcttgctctgtctcccaggctggagtgcagtggcatgacctctgctcactgcaacctctgcctctcgggttcaagtggttctcttgtctcagcctcccatgtagctgggattataagcacgtgccaccatgcctggctaatttttgtatttttagtagagacagggtttctccatgttggcccggctggtcccaaactcctgatctcaagtgatctgcctgcctcagcctcccaacgtgctgggattacagagatgaaccactgcacccagccatgttctgtatcttttttttttctgaaatataagctttattttaaattcaaagaaatattaaactttcttttacaaattataatcaaacactcaaacaatttaggaattttaaacactaattcttaattgaaaataatgacatccatagaatacatcctgatgttggccaacatgaagtttacttaatattagtattttatatatgcttaaccattcatccttcctaaaattcaatgataacaaagatttgactttataaggtgaagccttttatgtaatatgctagagataactttttcaaatacaaaacatttataccagcaaggaaattatgaaagcatatataaattatactgaaggatgtgatttaaaggctgtctgtatacatagatgcatttcaccttagaaagtacatatgcacatcaaaacactttcattgaatatagatgccactacattctcttacttatattacaaaagcaaacggcaggttcataaacgttcttctattatgtatcaactgaaaaaaacatatatacacaaaaagattttgacggcacatgggagtggaatgtgcctacatttagagcagagcttttacaggaccacctgtctccagccggctcccagggaccattgaaaacagctgctaccctcagaatgataagatggccttgttaatgagttcactggactctcgaatctcatcctccttgaccaccagcagaggtgaaacctgatgatgtcgccacaggttggcttggccagaagtccataatcttgaagtcgtagacacaccttccaagcatcacaatctttggtttctttaataacaatagcgtttaataattcctttcctcgccgggcgcagtggctcatgcctgtaatcccaacactttgggaggccaaggcagctggatcacctgaggtcaggagttcgagaccagcttgaccaacatggcaaaactccatctctactaaaaatacaaaaattcgctgggcatagcagtgcgtgcctgtaatcccagctactcaggaggctgaggtaggagaatcacttgaacctgtgaggtggaggttgcattgagccgagattgcgccattacactccatcctgggcaaccagagtgaacctctgactcaaataaataaataaataaataaataaataaataaataattattttcctcttacggcagttacaacatcagaaggtagcttcatgggttcatttctcaagataatacccattttttttctgtattttcagcaaggttttcttcttctaaaacctcaagggctgcaattgtcacttggcagcctagtggattgccaccgtatgtggacccacattcccctggcttaatggtcagcattatgtcatcgtcccacagcactgcagacacagagtatcagcccccagaaagggcctttccaaggaggactatatcaggtctgacattttcatgatcaacagccagccatctaccagttctggcctatcctgactgtatttcatcagcaatatacagatcctggtgcctggtgcagagctctcgcactcccattaagtaacctggatctggaacaacacctgcttcaccctgaattggttctaccatgaatgcagccacatttggattctgaaaagcactctccagtgcaggcagatcattgcagggaatgacgtcgaagccaggcataaacggtccaaaaccatcataactcgtcaggtctgtggaactggagatagcagaaaacgtcctaccccaaaagtttccagctgcggaaataacctttgctttgtatttctgaatgcccttcacagtatagccccacttatgagctagtttacaggcagtctctccagcttccattcctgtattcataggaagaactttgtggtagttgaaaagtttagtaatatactcctcatattcaccaagtacgttattatagaaagctctagaggttaaggtcaatttcttcccttgactctttagtgcattcacaatcttggggtgacaatgcccttggttgacagcactgtaagaactcagaaagtcaaaatattttctgccttctacatcccataagtaaatacattttcctctctccagggctacaggtaaaggatggtaattgtgcgcaccacacttagattccctttcaaaaatgtagtcagaggttggagggccttggactgttttcttcgggttttttttgtttgtttgttttttgttttgagatggagttttgctcttgttgcccaggctggagtgcagtggcacaatctcggctcactgcaacctctgcctcccggtttcaagcaattctcctgcctcagcctcccaagtagctgggattacaggcatgcaccactgtgccgggctaattttgtatttttagtagagatggggtttctccatgttggccaggctggtctcgaactcccaacctcaggtgatccaccagccttggcctcccaaattgctgggattacaggcgtgagccaccacacccggtctggattttttttttttagttgcaacagatgtagcagaagccactgaagaatgagctccacgactaagtacagcaaacctctgcaaaggtgctagtttggaaaacattgtgtccttcaagtagaaaaaccacagatcgactatttttttcttcccatggttcagactagaatacagatttttaacccaagatccaaggatgatcttcagagagtccaaaatctcctgacagtgcctgaggaccacccgggacacacactgtctacaaagcacagccatgttctgtatcttgattacggtgttggttacaggagtctacacatgggataaaaaggcatacacactattgctccaatgtcaatttcctgattttgatattgtactatagtatttttacactactataatatagaggaaactcagtaaagggtatatgggacatatctgtactatttttgcaatttcccataaatctatattattcccaagtaaaaagggaaaaacatacaattttttttgagacagggtctcgccctgtcatccaggctggagtgcagtggggcaattatagctcactgcagcctcaaactcctgggctcaagcaatcctcctgcctcagcctcccaagtagctaggactacaggcacatgccaccatacccacctatttttttttttttagagatggggtcttactatattgcccaagctaaaaatacatttcttaatgaaagatcaggatgagaaacaacaggcttatctgaacacctgcacaataaccaaatacaacttctagaagtgaaaatggtgatttaaataattaataaacttattaaactgcagattagacacaaacgaagaaataattagcgaacgaaaatatagctctgaggaaaacacaacattagagataaagaaacagaaaataggccaggcatggtggctcaagcctgtaatcccagcactttgggaggctgaggcgggtggatcacctgaggtcaggcattcgagaccagcctgaccaacatggtgaaaccccatctctactaaaaatacaaaacttagccaggcatggtgatgcatgcctgtaatcccagttactcaggaggctgaggcacgagaattgtttgaacctgggaggtggaggttgcagtgagccgagattgtgtcattgcactccagcctggacaagagtgaaactccgtgtcaaaaaaaaaaaaaacaaaaaagaaatggaaaatataaagatatggaggatagaatgaaaagagctcacatacattgaacacaaattctagaaagggagaatagaaagatttatggagaacaatgttcaaaggaataatggctgagaattttccagctttggtaaaaagcatcaatgctccttatgtgagctcacccagacctattactttattatttaaggaattattcactaaaacacatgctgctttaatgtagtttaattataatccagtgttcataaagatgatgtcatttggaaaaatattgattgggagcatttggggatcataaatttgaagtggtactaaaatactaggccacattagaacatgtggaaaaagaaagaaaaagcaacaaaaataaagttctaggccacaacaacacaaacactgaaagagaaggagattagagttaaagtaatcaaaggacatgtgaaaatggaaactaaagttatcatcaaatttaaaccttttaatgtcaagtaatgatgtttaaaatgtttaatgttgctaacacaaagtaaatggtggaatagagaactccaaaaatctatgcctctataaaaatcagtgaaaaaactggcaaaaactgtcaggatcaactttttcagaactttgaaaactaaccgaaagcttgtaacaagcagaggaatgtttaatcaagaaaaaccagctgagtggctcacgcctgtaatccagcacttcgggaggcca[134 bp omitted]gagacacgagaattgcttgaacctgggaagtggaggttgcagtgagctgagatggcaccactgcactccagcctgggcaacagagcaagactgtcaaaaaagaaaaaggaagaaaaagaaggaaggaaggaaggaaggaaggaaggaaggaaggaaggaaggaaggaaggaaggaaggaaagaaggaaggaaggaaggaaagaaggaaggaaggaagaaagaaaggaaggaaggaaggagaaaaaccagctgaatctccataagaacagtaagctttgtggtattttaacttacccttgtcccatctcctgctcccagcttggtggtagccctgaagataatgatctgcattcccagtacaggtaccagtaccagagagaaaagaatggaccttattcacaaagaattacagttgtttgttttgacttgtctggtggttccctggaagaacccacttgaaaggcttgtcttcatttgacctcactcaaactgatgctacaacctggggtagtgaatagcagttgaggcaaacaatacatcaaccagcaagcttaaaaggaaaggctggaggccaggcatggtggctcatgcctgtaatcccagcactttgggaggctgaggcaggtggatcacgaggtcaagggatcgagaccatcctggccaacatggtctctactagacaccccatctctactaaaaatacaaaaattagctaggtgtggtggtgtgcacctgtaatcttagctactcaggaggctgaggcaggagaattgcttgaatccaggaggcagaggttgcagtgagccgagatcgcgtcactgcactccagcctggcaacagagcaagactctatctcaaaaaaaaaaaaaaaagaagaagaagaagaagaaggaaaggctggaaaatggggcttgaataactccaacacatgcctgggaatctagaaggccacacacatacgccctgggctgcagctaggcgaatgcccacagaagaactaagtaggctttaatctctcacctctgcagacctcgaggctctgagcaagcaggaagagaaagataaggcaacgttgtaaactgccaggctgagtgcagaaggtatgtcccaacacatacacaaatccccttggcaaagactgggagacatactggttccaggcatttaaagaaatttctgttcaatcattagtggccactaagctaaccaagagacttcagtggccacagaggacaaggaatagagactacagaatttgttcaggaaaaaaactagacaaacttgtgttttgagacagggtcttgctctgtctctcaggctggagtacagtggcactaacacggctcactgcagccttgatctcccaggctcaagcaatcctccagcatcagcctctgagtagctgggactataggcatgcgccaccacaccaagctaatttaatttatttatttatttatttattttttgagatggagtctcactctgtcgcccaggctggagtgcagtggtgcgatctcagctcactgcaagctccgcctcccgggttcacaccattctcctgtctc[135 bp omitted]ggcctcccaaaagtgctggggattacaggcgtgagccaccgcgctcggccaatttttttttcttttttaagagacggggtctcactatgttgcccgagctggtctcaaactcctaggctcaaatgatcctcctgccttggcctcccaaagtgcttggattacaggcatgagccaccgagctcagcctaaacaaacattgaaaacaaacaaacaaaacagcaacaagaaaccccagggaagggacagaatctggtttccagagttgccacattatattatttgaaatgtccagttttcaataaaaaattatgacacctgcaaagaaagaagaaaatacgacccatccacagaataaagaaaaaagaccacctatagaaaccatccctgagaaagcccagatgttgggttttccttttttcttaatgtattttattttatttatttatttattttgagacagagttttgctctgtcgccccggctggggtgcagtggtgcaatctcggctcactgcaacctctgcctcccagactcaagcaattctactgcctcagcctcccaagtagttgggactacaggcacccactaccacacctggctactttttgtatttttagtagagacagggtttcaccatattggccaggctggtcttgaactcctgacctcaagtgatccacctgccttgtcctcccaaagtgctgggattacaggtgtgagccaccacgcccagccagatgctgggttttctaataaaaagactttaaatgagctatttaaaatacgtccaaaaacctcaaagaaactatgtctaaagaactaaagtatagaaacaatatctcaccaaatagagagtatcaatacagacatagaaatataaaaaatgaaccatatagaaatttctggagtttaaaagtgtaataatcaaaatgaaaaattcatcttctgctgatgctaggagtagggacattgccctcatctctttttggggttctttctgttaaatatgaagacttgcttttttttctttttgagacaaggtctcactctgttgcccaggctggagtgagtggtgcaatcacagctcactgcagccctgaactcctaggttcaaacaactctcccacctcagcctccctgagtagctgggactgcaggtgcaaaccaccatgcccgactaattaaaaaaaaaaaattggggctgggcgcggtggctcacacctgtaatctcagcactttgggaggccaaggcaggcggatcacctgaggtcaggagtttgaaaccagcctggccaacatggtgaaaccctgtctctactaaaaatacaaaaattagctgggcacggtggcgcatgcctgtagtcccagctactcaggaggctgaaacaggaaaatcgcttgaacccgggaggcagaggttgcagtgtgccaaaatcgcgccattgcactccagcctgagcaacaaagcaagactctgtctctaaataaatagataaataaataaataaataataaataaataaataaatattgtgtagacacaggatctcactatgttgcccaggttggtctcaaattcctggcctcaagtcatcctccttagcctcccaaagtgcccagattataggcatgagtcaagacttgcagttttaaggccaggtgctggaatttcaggttaccattattatcaaaaagaatggtttgttgagcttaagtttagtggcagtaaagggagtggacaaagctatataagagcaatgttttgtatagtattgaaattaagttggtatcaatctgaactagattgctaaaaattaagatgttatttttaatccctagtatggtctgaatgtgtcccctccaaaactcaggtgttgtcaatgtgacagtattaagagatagggtctttaagaagtgactaggccatgaggggttctccctaatgagattaggtgtccttataaatgagatggagggagttgcttctctcatgtccttctgccttctgccatatgagaatgcagcaaaaagcgctgaccagatgctggtgccttgatcttggactttccagcctccagaactgtgagaaaataaatgtctgttctatacaaattacccagtctgaggtattctatcatagcggcaccaaaagactactaaaatcccctaagtaggacttgcatcccaaggaagtgtaagacttctgcactgaaaactacaaaacattgctgaaggaaattaaagacctaaataaatggaaagatagcccatttttcatggatcggaagatttaatgaagtactgatacatgctgtggcatgcataaaccttgaaaatatgctaagtgaaagaagccagacacaaaagaccacagtgtatgattccacttatatgaatgccaagaataggcaaatccgtagggacagaaagtagattcatggttcccaaaggctgggcggagtggggagttactattaatgggtatgaggtttctggtgggggggggttgttgttgttgttgtttgttttgtttttttgttttttttttttgtttttgaaacaaggtctcactctgttgcccaggctggagtgcaatggtccaatccagctcactgcagccttgaactccttagttcaagcaattctcccaccccagcctccctgagtagctgagactgcaggtgcacaccaccatgcccagctaattaaaaaaaaaacttagggacaggatctcattatgttgcccaggttggtctcaaattcctggcctcaagtcatcctcttgccttggcctcccaaagtgctgggattacaagcatgagtcatcgtgcccagccaagacttgcagtttgaaggccaggtgctggaatttcaggctaccgttattctcaaaaagaatggcttgttgagcttaagtttagtggcagtaagggataaagaacagtgaaacaaggagcatatagtattaatcaactacagacaactgccctatttgtaaatagaagcagggaaataatatatatgtgtagtagcttataaatgcgtaaaaattatctgggaggataagcaaatgtctctcaaacatctaaaagcttccttcaggctgggtgcggtgcttcatgcctataatctcagcaatttgggaggccgagatgggtggatcacttgagcccaggaattcgagaccagcttgggcaacatggtgagaccccgtctctacaaaaaaatacaaaaaaggccgggcgcagtggctcacacctgtaatcctagcactttgggaggctgaggcaggcggatcacgaggtcgggaggtggatcacgaggtcgggagatcgagaccatcctgactaacatggtgaaaccccgtttctactaaaaatacaaaaaattagccaggtgtggtggcacacatctgtagtcccagctactcgggaggctgaggcaagagaatcacttgaacccggggaacagaggttgcactgatccgagatcgtgccattgcactccagcctgggagacaagagcaagacttcatctaaaaaataaaataaaataaaataaaataaaataaaataagccgggtgtggtggcatatgcctgtggtcccagctacttgggaggctgaggtaagagaatcacttgaacccgggaagttgaggttgcagtgagctgtgatctcactactgtactccaggctggatgacagtgaaaccctgccaaaaaaaaaaaaaaaaaaaaccttatttcataaatacggctcatgcctgtaatccgagcactttgggaggccaaggtgggaggatcacttgagcccaagagtttgagaccagcctaggcaacatagagagatctcatttctactgaaaattttaaaaattatccaggcatagtggcgcatgcctgtagtcccagctactcagaaggctgaggcaggaggatagcttgagcctgggaggctaaagcttcagtgagccgtgatggcaccactgcactccagcctggatgacagagcaagaccctgtctcaaaaacagttaaaaattaaaaattaaagaattagaaatacacacacacacacacacacacacacacacacacgtatgtgaagtgtaatggcaataccattttttctatgaggttgacaaaaatctgttgcattgctcaggctgttgacaaggctgtggtgaaaatggcactcacatactcatgctagcttctccttgctcttgcttggaccagccatgctcgttcctacctcggggcccttgcacctgttgctccctctgcctggaacaccctttgccaaaataaccatgaggcttgctcctttcagccaacctaggaccaaattcattgccccctccttagtgaagtctcgctgaatgcctcctcacccaccacctccccacaccactctcacatcgctcattttcttcattgcaccatctttatgaggaatgatttctcttttattctctttgttaggtcagaggtcagctaacattttctgaaaagggccagagagttaatagctcaggctttgcaggccatatggtctctgttgcaaatcctcagctctgcacgagaaagccacaaacaatatgtaaatgaagaagacactgtaaatgatatgtaaataatttagacactgaaattgatatgtaaatgatttagacactgaaatttgaatttcacataatttccaagtgtcacagaatattatttcttttaataatattttttcattttcttttcttttttttgagacagaggctggagtgcagtggtgagatcttggctcactgcaacctctgactcccaagttcaagcgattctcctgcctcagcctcctgagtagctgggattacaggcgcgtgccaccatgcctggctgatttttgtatttttagtagaaacggggtttcaccacgttggccaggctggtctagaactccttacctcaggtgatctgcccgcgtcggcctcccaaagtgctaggattacaggcatgagccaccacacccagccccttttctttttgagacagggtctcactctgtcactcaggctagagtgcagtggcgtgatcatagctcactgcaccctcaatctcccgggctgaagcgatcctcccacctcagtctcccaagtagctgggactataggcttgcactatcacacccggctatttcttttaatattttttgtagagatggggtcttgccgtgttgcccaggctgctctcaaatgatcctcctgcctcagactcccaaagtgctggtgattacaggcataagccaccatgctggatccaccttttttcaatcatttagaaatatgaaagccagtcttagttcaagggccataccaaaataggcagcaggatggatttgcccactcgtgtgtcagaacatcaactccagggcactattgtctgcttggttcactgctatatccccagcacctagaatagtgcctggcacccagtaggctttcaggagatgtttaccgagtgaatgagtgaagtctttttctgtgtgtgagatggagtctcactctgtcgcccaggctggagtacagtggcacaatctcggctcactgcaacctccgcctcctgggttcaagcgattctcccgccttagcctcccaagtagctgggactatagcgtgcaccaccacacccagttaattttagtattttttagtagagacggggttttgccatgg[131 bp omitted]tgaaagagtgaagtgaatgaatgcatgatcaggcacagtcccactcgcagggcttcagtttgctccagcctggactccggcaggctcccccagcaagactaagagaaagatcagaaggctgagtccagagtggtagctcaacatctttatttttcctctttagcccgagggtaatcctgacaaacagcttcagccaggaggaggcagagaggactgggctgggcaaaggctccaccaggacctggcctcctcctcctcctcctcctcctcctcctcctcctcctcttcttcctcctcctcctcctcccatggggttggggttgggattagggccatgatccaagcttggcatccctggggaggagggaagtgggccagtctgcagcctctgctgtcccccgcctctgacaaccacgttcatgggaaccagccacctccacatgttgggcaggagggaccctagggagcggccctgacccctccatgtgcatgcgcacagggacctgggccagcagggcctgatcagtgtccagacatgcggctctggcctgtggcccagttggcaaacataaagcctagactgacggccatgaagaggactcccaggactccaaagcacagggcctgtgggccagagagacaagatggggctggttgggactcctcacccagttgccttctgagaatgttcctcaagtcttccacctccttcagagagtgctccatccattcctgaccctcctctgtatgccctctccttccttacagccagcccctttctgcgagtccttccaccttcccaggacccatgacagaatacgttcctccatcctccttcttcaaagtgcttccagctctcttcccaatagtgctctttccatctgtctggagaatgctccctctatgccagcctctgtttgagtgctccctgtcttcctggaccctgctggtgctctgtctcctctgccccttcctagacaatcaccttcattcttccagaccattctttcagatgctctcccagccccctcctatgcatgtccctttcacctccagccatcctggagtgagcactccctccttggagtgctccctctctccctagctctgccctggaatgcttacctggatcttgggccaggataagaaaggctccacctcagagggtacaatgcggaggtagaagatgctggggaggatgaagatgaggctgggggctgaggtggaccctggagaacaagaagaagggacaggagtcaacctgacttggggacaaggcccatattagatggggtatgggactggggtgaggtttactgaccgataactccaaagatatcccggatggttggcacacagatgacaaggacattgaccaaaacaagcaggatcagagctatggccacatgtcgtggccagctgaaggccttgcctgggaaaagcagctgctgcagggcccggcggatctgtggccagagtagggtgggacagaagtcaggacccaagtgctgccccccttccacgtgatcatctgtctttagctccaccctctggctgagatccctgatttcccctccctctgactatctatggctccaccctgcctaacccaacatctgtgtctctatgttctgaacaggcttcctgcctccatcctctgacaatccacgtctcttccttctgtctgaacacccatcggcacctgcacccactgtctgaaatccttgcctcctcctctagctgaccatctttgccttctccttctgtctgaccatccaccgatccttccaccctgtgtgagctccctgcctctctccatctgacctctacctccctcctctgtctaattagttctgcctccccatctgggagacttgaccctcctacatcccatcacttcagcctccaccctttttctgtccatccctgtttcttaattctaccctccaactgacccttcctgcctccctcttctttctagccatccatctgtgcctcctccctccaactgactaccctgtcccctgaccctctctctcctgctatctatgtcctccccacttctgtttatcgatttttgccatctctgtccatctgaaaacactgccctttcctgtctgtccatccttgcctccttcatccatccatccactcctgtttccagccttgacccacacatccatgcctatgccctctacccatccatccatgtccctctcagccgtgggccccacgcacagggaacagcacgactggcacagtgagggtcaccgcgagcagcacggccaggcgcacacagaggatgagcgggtccttctggctgtacatgtgcagcatctccgccttcacactgcctgggccatgagacagagggtacgggatgcaggatgtggagagagcaccaggaccaatgccccagaaacccatacatacatgcacagtgacaaaatccacacaagtgaggcacaccttctgtttggaaactgacaggtccgtggtcacagaaggaaagagctcagaggctcctgccccaggccttccccctccccccagccctagccccagccccactcactgtagaaggtgaggtatccaaaggttgctgtgagcccatacatgcagaacatggccccaatggacacgttggccacggcctgcatcctgcgcttggagggcctgaggtgtagaggtcgtggaactgtcatgcccagaccctgagacttgccccaggtccctcaaagccagcctccaccctccagagtccccttctcccagactgccattcagctggcacacatggggacacccgtctctgcctcccctgtgactagccaaaatcccctctctgaccatccatatctcccccgatatgactgtctccctctcccctgcgtttgactgccactgcctcttccatctgaccatccatgctgtccctctgtctgatcatccacacatctcccatcatatcatccctgcctccgcctctgtctgtccgtacctccctatccccatatcaccagccatgcatatcaccccctccatctgatcatctgatctctgcttcccaactctgtccatccacatttgtgctggatattaaaataggagaatacttaagccccaatcagcaaacagtcactaccctgagtgccccaagacctcctggccaccccaaacccctcccatgacacaacctagcttccaccaagtgacagtcccaggactgctgtagggagtgtcagacattctggttaccaccccacttgctggcccatcattcaggcccacttgcctgcccactcaccggcagagctccgtatagatgggcagcacctcagggtggcagacaaaagcaaaagccataatgggcactgtgtaggacatctaggggaatgcccgagtacatgggattagagccaacaggggtccatccccttcttcccatccccctcccgccccgtaatcgccctccatatcagacacatagaagctcccaatgtccaatatccagctccactctgagcaggatgcaccatatgacagaaccagagggcctgagtgtgatgcaatctcctacatgcctgcacacacacctgtgagtcaactgtgaacatctgggcctcacagctgctgttgagtccttggctggggagtcccacgagagcttcactctccattgctgtttcattgtggcctatagcacagccaagttggaacttcttgtagatgacctgaggatgggggcagcagggaagccaggtcatggaggaagctatgtcccaatgtcccaaactctctccccgcttctctgtgactcaccgaaacaaggaaaaacagcatgcaggtcagagagagaccactggtgtaccccaggtagcctaagaggggcaaaacacagagtctcagaaatcagccaggcgtggtggctcacacctataatcctagcgctttgggaggcctaagcgggtggatcacctgaggtcaggagttcgagaccagcctggccaacatggcaaagccccatctctactaaaaatacaaaaattagctgggtgtggtggcgcatacacctgtaatcccagctactcgggaggctgaggcaggagaatcgcttgaaccgggaggcagaggttgcagtgagccaagaccacgccattgcaccactccagcctgggtgacagagtgagactcggtctcaaaaaaacaaaacaaaacaaaaaatcaatggacccccggaacagtgaactccaaacacctagtctagccttcaaggtctacccaccccagttacctttgcataagcttctacttccacccagaaaaacctcccctccatagcaaactcctactaatctgttcaagcccacatcaaataagctctctcctagtgtgctgcagcccttgaaaatgaatgggggttttctcagtctggcttcttctgtctaatcccactacccaatggccaacccagggagcctcttacccaagtgtttcatgagggcgaggggcaggatgattaacacactgacgatgatgatgaggaggtttcccttcaagaaccagtccctagagagacaggaagacacagtgcctagctgccagccaaaggaaactgtcaggcagacactcacagaagacagctggacaggcagctttctgccctaagtcaggagagttaagctgacaacctcagcttgagaagtcattcaggtggtcacagtgacaaacggcacaatagggttgacaaaaacagtcaagctgattatgagattgtcagatactatcagtgggacacagctaacacatacacagctggacaaaacttgccatcagacttcgcaagtggttgcacaaccagaaggtcaa[137 bp omitted]catggtgaaaccctgtctctactaaaaatacaaaacaaattagccaggcgtggtggggagtgcctgtagtcccagctactcaggaggctaaggcaggagaatggcatgaacccgggaggtggagcttgcagtgagccgagatcacgccactgcactccagcctgggcgacaaagggagactctgtctcaaaaaaataaataaatagataaatagccaggtatggtggcgcgtgcctgtaatcccagctactcgcgaggctgaggcaggagaatcacttgaacccaggaggcagaggttgcagtgagccaagatcgcgccattgcactccagcctgggtgacagatcaagacactcaaaaaaaaaaaaaaaaaggaagaaagaaagaaaaaaaagaaggaagggaggaaagaaagagaaaggaagaaagaaagagagagaaagaaagaaagaaagaaagaaagaaagaaagaaagaaagaaagaaagaaagaaagagaaagaaagaaaggagaaaatcagtgcaacacaaggtgccagacacaaagagagtgagtcacgatcgtggtatgtctgacaggtagagcaacagtctgatgatccagtagacaagccacgatgcagagtccatcaaaaagtcagaaacacacatgcatgcttgtttgaacagctcaaggtttgttggatgcctgaaagtatgcctgtggactgatttggctgcacagccaaagaaagactgaaatagaaacgaaatcatccagctggccacactgttggaaccaagctctgagaaaaggtgggatctgtacagatattggaggaaggtgaccaggcaagacagtcagttaagacagaatcagctgaacaactgctcatgcattcaaaacaacttgattgaatgcctatgttctagacattcacatggtctctttctatctcatatacagttacacagaaataaaccaatgggagctaactataataatgagacatctctggtcacactatcagctatctagtgttctcagaatcaaaccaaaaatctaaaaggatacacacagagagtaaagatcaagcactcagttaaaattgtcagactggccgggtgtggtggctcatgcctataatcccagcactttgggaggccaaggcaagcagatcacctgaggtcaggagttcaagaccagcctggccaacatggcaaaaccccgtctctactaaaaatacaaaaattagccgagcatgggggctgaggcagaaggatggcttgaacctgggaggtggaggttgcagtgagccaagatggcgccactgcactccagcctgggcaacagagtaagactctgtctcaaaaaaataaaattaaaaaattaaccgagcatggtggtgcatgcctgtaatcccacctactcaggaggctgaggaaggagaatcgcttgaacctgggaggcagaggttacagtgagctgagatcgtgtcactgcactccagcctgggcgacagaatgagactctgtcaaaaaaaaaaaaaaactgtcacacagaccagagtcagactgacaaaaccagagacacatctacacaccatgcaaagcccatgggaccagaggcagagttagcccatgggaccagaggcagagttagccactggacacacagagctgttcatgaaacacacagaggcagctacacacgtgcagctggagcacaagcactgcaacacactgtgcatacacactagccctgctggagtcccatcgtgcacatgccccccacacataccaagccagcacagcggatccggactcacacacagtcagccagatgcataatcagaacagtccagcatatatggttgcaaccataatacagaggacacatagccacattcagggatcacacacacacacacacacacacacaccagagagaatttgccagaacagccaccaaatcaaacacagagatggagttggctggacacgtacagtcagagtgagtcacacatagttggtaccacagcatactacgtgcacacagacacactgctggagtcagcgatcacacactcacagctagacggagtcagtgatcacacactcacagctagacagattcagccagatgaacctagaatcaagctcaaacaatcagctggacaggggaagtcagagtgaccgagggtaagacacatatggttggaatcccagtatacgggacacagctgtagtcaatcacagagctagcccaagagaatcagccaggacagcagacgcagagtcaaacccacaggcagagtctgagtccattggctatgtacattcacacacacatggtcagcagcagagtaaaccggacataaagagtcagcctccagccagaagcagccagaataagtcacaaaatcagcacacggtcgactggactcctgtggtcagagcaacaggcacacagaggaatcagtctgacccaagtggcctgcccagcagtctcaaactagaacatctggaagtcagctgcacacacagcgctgaagatactgaccgggcctcacaggcagagtcaaggggctgctggccagccaaggggtgttgctcactcacccctcggggtccatgtacaggaaggtgccgataaccagggggagctcagatttgatgatgaacaggtaactggacatggctggtgcaggtgggggaggtgtaagcagaaggattctcttcatgcccccaccccgtcttccccagcccagcctggggaagcccacctcactccgccctctccccccaagctgacccccacctcccagagtcctcacccccaacattgtgcagacagatgactgtggccaccactaccttccccgcaggcccgaatgccctctgtcccagctgctcataggctcggatgcctagcggggggagtcaggaacagggttgaaggtccaggaggccaggccagaggtgcaggccagagggcccaggagctggggagttggggcttgggggaaccggctttgactgatggaggatgaaggtgggggttaagcagttgggcttgagtttgggggcagagtctgggaggtgggatctgaggccagggaaaaggatgagggctggaggtaagagtaggggtcttggagccagactatgaactgagaccatggtaggagctggggaaccggggactgaggggtgggggttagaggtagagtgtagtggtctgggggtgggttctggggtgctgggtccgggatctggggtctgcattcagggagctgggtctggggtctggggtccaaggtctgtgttgagctctggatgtggctccagagtctggggtccaaaggggtggagtggggactgggatccaggctctgggtctcacctgcaataccagcacaggtcagcaggaggtggatggagtaggacgacagaagcgcaatgcacagcagcagggccctgcggcaggtggcacagctcagacctggccccaggcctcccacctgccccacaacacccctggccccgcaggccacctatggactcacaggaagaagatgacccccgtgtgggccatggcataggccagccccaggatgccgctgcccatgatggcgttgctgaggttgaacactgacattccaaacgatgtcttcccctcgaactgcacgcaaggagcaaagcccgggcacacattgggacagggcacagggtaaggagactaatgccagggccagggaaagactagagaagaagcaagcggggtggagagaagccaaggagagaccatcggaggagggaagaggctagcagggaagaagagttgaagatggaagaggctgcgaatggggagagctgggaagggggaaactaggacaaactttggagggagcagctggaagtggagaggaccgggggagggtgaagcagccaccagaggtaaaacagctggggaggggagacgctgcgggtggggataggctgaggatggggagtgctggaggaggaagaacagctggaggagaaaggcaggccgggaggggagcagccagggagggcagtcactgggccgaagagcgggtggggagaaacaaggccagggagagagctggaaagggcatatctggggaagaggagtatctggagaggggagcgaccaagtagtgtgtagctgtgctggggagatagctgggcaggggaacagcagggaggaggaggagtggggaagagggagcagtgcgggaggagattagctggggaaggtgccaccaggacagatcctgtggggccactcacatccatgaactggaccggcttgctcccaggagcaggaccacgactgggcaggaagccctcacgttcttgcctgtagctggatagggcagggaaataggggccgataagagggaaatcctaacccctgatccctgagcccacctccttggacccctgactcaccccacagcatccgaagggagggctccattcatctttggatcctgcagttccatcctgtgggcaaagaaatggggtggggggatcagagatggaacgagcatgcttcaaagtgaggggagctgaagaaggggggaggggagtcccatagagaccgatggaaagacggagaaagagacaaggcaggggagcaggaacagacagggatagaaatggaggcagactgacagagaaagagatgagagagagagaagaacaaaaatcagagaaggagagaagccaacagttagttactcagagagacacagagagagccagtgagagagaaatagtggggaagagagagacagaaagctacagagagagccggaccccagcgcagatgagccgaccacgtggagaagggatagcctctcctcccagaccccagactcacgctgtctctcttgccatctgtgtctttcattccccggtcccccgcgccaccccctctccttccctccaccctcaccgcgtggccaggcggctcactccttgcagggacacgtgtcggcctggctgccccacccctcctaatgccctcacccccctccttcccgcctgggcccccaagcccgagaccagagctaatgcaacctgttgagtgagctgagggttggggacagactcggagacccctgccccagacgctgcaaactgctctctgccacgactctgaatatcctcactagaagccaaagacaagtgcccgaaccgagccccttcccagggacagaaatgacccagggactcccatttgaccccaattctagggcctagaggtcttttccagggcccctagcaagtcttaaacactcatcttctggcagaagtcaatttggagacactgccagacttgagaaacttcctaggtgtggggtgtggggtgtctcaggaacctggcccgagccctcatttcccctccggaggaagagctatttctgagaccttcatcaaagaccccctcccgtggcctaccgagtttcctggggtgggggtgtctctgcaatccccacccgagcctggagcccctgtcttgtaggtacagcgtctctgaagaaaccccagctccctcccgcgcttactccttgggaaggaggtatctcagaaacccccattcaaggtccccattagagctcaaactggctcaggaaatccttttcccaagtcctgaatcccgttcctgggacagggagggtctcaaggagtcccatcccccaccaccagcaccctccggagcctcccacccacacctgaattcacttcctgggatcagggtacaaaaaggacctccccatacacgccattccattccccactagtgctaaaatgtctccaaggaaccccgagccccctcccaggacccctactcatatctcaggcccccaggaacaccatccccgcagcccacgctccctcctcacctacctgctcctctcagctcctgaagtggccgcaactcagactcaggttcgggcaccctctcggctgcctaggctcctgctctggagcggtacttttttttttttcctgagaagaaatgttaattttaatttcgtttccctccttctggccctgggcgggggaagaggtggagaaggggcgccccctatctggacccacttggagggagacagcggtttgtttgtgtgttgatggtgggggaaatggcctgaaagattgagggtgtagacccacagctagagagagtgacaggcagacagaggggatggactcacagagcagacggacagcaggatgggatggatggcagaaaaaggtgcagagaggagacagagagagagtaggagaactgaagttacaaagaaagcaggcatgagaaacagcacaggaacagacagaccacagaagggacagaaagacagatgggcgggaggaggggatgctaggggagcttggaagacaggcagagacagggagaaagggacacacaggcagactcagaaacaaacaggtgggtagggataggctcgtggaaacacctgcagaaaggcaacaggcaattgggctcagtcatagacaggagacacaggctggccaagaggtgggggacagagccagacagctccccaaacagagggtaggaccagacacaccagctcagagagatgaaggggcagagagagtggttgaggcagagagactcctggagggacaggagaaaagaggcagagagaggcagattcaggcagagaggcctggggacagcaggggaacaggtgcaggggtagtagccaggctattccaggcagacctcaggcagacagcctaggcacgagaggaccctagatcttgggggcccccagagggaggcagggagggcatttgtggctgggtggggaatgtggactgtgaactcacactgtccgcaaactgggcgggcactgtagtcctggaccccaccccaagcgtggggtggggcttgtccaagccctgagaagtcccactatctgtctgtccgtctgtcttctatgggagtccgtctgttcactcccctccaggcatatgacaggcatgcctgtcccaggcaagccacgtgtccgctacaggatgtcaggcagggtggacttggggtctgggaccacctcgactgggctgcttgaagcccaggtggacaagaggcctctgtctgggcccctcgcccgcctgcccacccccgacagggaacacagaattcccggaaaggccaggagctggctggggcttcaaagctggcctagatgccctcaccccacccacagttggaggaggacaagggatggggcgtttacttccccacagcgggagagagactcctgcacactcaggaatcgcagctacacaacaggacccatcacagccccatcaaggggctcagatacgggggccaactcgccatcactcacagaggtgcacaaagactcacagccacacaagagaataaagactgacagacatgaacacacacagactcaccactgcacgttaagagcaatggctcatgggacagtcacacacgtggccacacagagtgacgatagtcttacagctatcaataccgacaggctcagagccgctcacagagagcacagactaacacagggataggcttgtgccgatttccagacactcgagactcctgaacctcaccgcccgtggacccacagccatgccaaagacaatcaacaggcaaatcacacacacagattcacagccacacacagagcacacaattacacacagctgatgacattgtgtgtgggtcctgggtctttcccacacacacgatccaggttcagatggccctggatctgaacctgaatccaggttcagatgaccctggaggcaaacttccaggttcaagccctaaaatgatatctctgtgtatgtgaacttgaatgtgcacttgtgaccacatgtaaccacatacagctccagtcacagagagaggcactcataggctgacatgatttttgtacaaacagaaaagccatagtctccttctctctctctctcctctctctctctctctcacacacacacacacacacaactgcatttcagcaaatggctgcacacagccgtgtacacacacagctagtcacaaatcaagtcagaaaagaaacatatagggaaagcatatacctgcacacaaacacaaagcacaggaatgcagagtacgcttactatcgttgcaaagaaaaaatccagaaaccacactgaaagctacacaaggaaaaaacaagagaaccagatagtactcataccatggcaccagaagaaacaccccgagggcacacatacctgcagccactcgctaagaagagacacaaatacagcagcagacacacaaagaaagatacgtgcgcatagatacacatataggagggacaagtactctgacacacttgtcacccacgaccattacaaaggagacaaacacccaagcaacacacacacacaacaacatatagatgaactgcaccgacagacagtaccaatgcacacggttgccaaaaaaaaaaaaaaaaaaaaggtatgagttgggccgggtgcagtggttcatgcctgtaatcccagcactttgggaggccaag[133 bp omitted]gaggcaagagaattgcttgaacctggaaggcggaggttgcagtgagccaagatcgcgccactgcactccggcccaagcgacagagtgagactccatctcaaaaaaaaaaaaaaaaaaaagcacaagtttggcaggcggccatagacagaacgcagcaccaggcaagttacataggaagacgcaggcacagctcacatacgtgtggctgtggctgagaacgggcaggtgagatacactcagcatattcacacacacgtgcgcacacactcctgcccaacctcctccagcctctgtctcctttcctatctactctgatttctctctcccctcatacccctcccccacccagagccattacacatctgtgctaccagctggccagggaaagagacacctgtcactagaggctttgacccagatggctaaaggtcggggggtgggggggatgcaggtatccatatttcaagtctgaagtgtcccgtccaaataactagcatactttatttggatttaaaaaaaaaaaaaaaagacaacccccctcccctctgcatccattcgccgcctccctgccacagcctcctgctctgattgctccccttccctcccagggcctgcctctactggccttccaacatggaccaacacagggctaccaggcacacagcaggcgctcaacaaaggccacttatctaatgtcgtattattatcattacttttatttctgccaaaggaactcttctacgggagagatgaacctccatccagctctgagaacccgacagctctgctaagtttcagggcactgcagatagcaggtgctcaacataagccggtatggcagcgggaaaacaaagggaatgtgtgatctggctgcttagaggaatttgctttagaaggaacagatgtctttaagcaggaccgaggccttgaggctgtgccagggataagaacactttgttagttcatcaaagtagggctccttctcagggtcatttaaggtttctgttggttcagtaaaccagacccttgtgtgacacatgggagtcccgtgaaatctgttaaaagtcactttgggttatcatcagttctaaggagacatttgatgaaaacagctcacttcccggtagcatccaggggagggagggacacagtgaagcagttaacagcaaaagctttctcagctctgccacttattagctgtgtggctaaacaagcaaattcctaaacctcactgagtctcagcttcctcaagggcctaataacgcctaactcattgggctatcgagacaattgaattaattaacacaggcagagcacttaagacaatgctttacacatagttattgctcaatacatatttgtgggaggaattaatgatttcttctctgcgaaagcaaagtcccacttgctgggctgcatatgggattccaatctgtcctttcatgcaggctccccacggagtaactctttccagtcacttcctttcctcaaagcagcccctgggcagcaaagtcctagtcccctgcccctgggccacccccctcgttccctcacactgctaagatgcccccaccgggaaagagctggcctggcagctcccccttccttgacccctccaggaggccaagggaaggacacctttacactcagtggggtgccgggtgggagctgcaggccgacaccctacttcgggaagagcctggagagttcagagcctggctcctgtcccccaaacccccggtcctgctggaggaagcaagtttctttgctaaaagttaaacatcctcttcgtgagcgacaagaaaacaggacgtgggaagcgtcccacagggtgaacatgggcccccaatgcctggcaccccctcctctcttgtggagcggaggcctggtggctcgaacccttcctttctcacactcgctcgcctctgcaggggagtcatgttcccacagtcccacaatgcccttgagttctgctgacaaagctctggcttcttccctggttctcagagtctctacgcctccacccagggctccatagaaatgcaggacgcaccactggggaaaaaattaaggaacgaagcaacaaaaggatgaattcaaccaacatttattgaacaccaactgtgcgccacccctgttccaggcactgggaggcagcagtgaacatgacagaacaggaatccctgcctggtgaagctcgtgtgctaaggaatcaatcattctgttttttttttttttcttgagacagggtctcactctgtcgcccaagctggagtgcagtagcacgatgtcggctcactgcaacctccacctcccaggttcaagtgatcctcccaccttggcctcctgagtagctgggactagaggtgcgcatcaccacgcccagctaatttttgtatttttagtagagacggggttgcactatgttggccaggctggtctccaactcctgacctcaagtgatccccccgcctcgccctcccaaagttctgggattataggcgtgagccactgcatccagcccttttattttttaaagagacatgggttctcgctatgttgcccagactagattcaaacccctgggctccagggatcctcccacctcagcctctggagtagctgggactaaaggcacatgccgccgcccctggctaatactcatatgcatgttgccaggattaaaatgaatgaacaaagggaaggacatgctggagccaacttatacaggttgggaggagctgttcaattttcagaaattttgcaaactggttgttaaacagctggtttaacaactggttttgtttgtttgttgagacagggtctcactctgtcacccacagtggagtgcagtggcaagatcaaggctcactgcagccttgacctcccaggctcatgcaatcctcccacctcagcctcccaagtagctggaactactcgcacacaccaccacgcccggctatttttattatttgtagagacggggatctcaccatattgcccaggctggtcttgaagtcctggactcaagcgatccttccacctcagccccctaaagttaaacagctatggttaaaaatgaaatgatataaacttactcaaaactggtaacttcctaattttaccacattccactattctctatgctcttgaggtcatttacccccattttatctgtatggtaaaaataatacatgatagtgcactactgcatctcttttaaactccctgttcagtgaccacaggtcggtaccttgaaatctaacaagaagattgtacctaagccatggaaattggtaaatgctagaaaccagcctcccttccccccacccctccccgccaccacccccgccccagccagtggttaaccatttaccagcacaccactgagggcatttagagcctagcacatggtaaacactatgataaacgttttcattatttttccgtttgtccactgggtcaggatgtatagtctttttttgtgtctgggatggaatttaaaatatttgaagatcacagaattacaaaagcccagagagtggctaagctacacctatttaaccctcccaataatgctgttaagtctatactattgattatccccactttccagacagggaaactgaagttctgaggcagtaaaactcaggcagcgccatgcattagctgtagtgcgatctgaaattgcagccgagcagcctccgcgcgctcgcgcacttcaagaacgcattttccttactgtcacgtttatgccccgagtggtaatttcgcttcccggcacgcgaaaaatgaatgggcgccatcttgcgcgtggcatcttgggaaatgtagtttacaggctcaataacaagcacggtccaagaagggaggggcgggggagcaaatcgatcttggcctcggaagaaaaagaacaaagaatcgctggcaacttgcgcgtcgcgtcgctgcagccacgcagtgcgtggattcagccgctttggccgtgcccgttgcatgccgggaaacgcagttcgcgagccccggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaaggtgggccctggggcgcggaggacaggaatgcgggcggaggctattgaggcacgcctgcactgtcccgcctgcggggaaaggagggaggtccgccctgggcgccgtagctgtgtatggttcgggcggctggcaccgggtgggttctagacccaaggtttgtctgcagaaggggaccagtagacggggtggattcgaggtggggacatgggacgcagcggtcggagccgcctggaggggtacccggtggtcccgatggagctatcatctttgaggtattgatgaggagggacggggagtgtggtcagaaggctgttttgggaggttgggtggagcgtgagggtggggtgttactggggaatcaatgggggctaataagaatattttagtcgaactgttgttcattgattgattaatgaggggatggcagagtaagcaactagaatataacgagtgatggatgggaaaatgatcccccaggtattgatggaggtatgatattcaacgggttaatggaaagtgatggggcatcgtaatggcaaggatgatggtgaggttgtggggggaataatagatggatggaggtcatgatcaaggggccttggtgaaagaaaagataatgagaggctgatggtgttgtagtcagagtcagtagttgggctatggtggcatgaccgtcgaggaattaggggacagagtgagtaaagagagggcaatagtaaactagggttgggggggttaacttctgttgatacatagtaggtgaatagtaaactgttggagtgtgatcatccagtgatggatccatggagagcagggtggacagtgaggggagaatggggaactgatgtgtgatcagttaacgtgtttgttaatgaaagagttacagggcaggaggctagtgctgtgatctatgaagggtctattggagaaaactgagttaatgggggctgataaatcagtaattgaatgcttaatggggagctaatagaccatgattctccaggcattgttagaggttcataaggatgtagtaataaaggggcctaatcatctaagggattaatggcgaatggggtgaaacgagagagatatagggagtgggaggtacaatgaagtagtattaggataaaggtggaaaacaagggattaatgggggctaataggactatatgaatctaggggcaatggggacaactggggatacagtcagtgagattttaatgggcatgacatgagcagagaagggttgatagtggcagttgcagggtttaatgtgtggagtgtgggtgacagtgatgggaggtggacaggttcacaagtgggccatctatgggatgaatgttgggtttatggggtcttttgtgggaactgtggggtaagtgatgggggcgaggagggtctgtgtgataagcagtggagcctgagagttcagtgattgggtccttcaggccctataaggtcagtggggtcagtgccagggcttcagtcagcccatcttctgtgtgagctgtcatgtgggtcagatgagcccagtttagtttgtgtggttctctccgccctacagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggtccctgactggtgggcaggtcactgggcggtgaggtgggcacaggaggtaaacaagtaggctgggtctgcagagctccctgtggtaggtgggctgactcagagggtctctggggcagggagacaggcaggaagataggcagaataccggagaggagttgggcacctgggcaatggagatatgtgggtgctccccaggggagaggggtgaattttgcaagggtctccaggttggagaagtgggtgcagctgatcaggatgctttcactatgtatgcccaggcgtgacacgggcagttgacctgtgtgcagccccaggcagctggagccaggtgctgagccagaagatcgggtaagtgtgggggtcccagatgggagacccaggagggccggctgggtgggaggggcccgggagcgaaactaggctgatgtgggccatgttgtccacaggggccaagggtccggccacgtggtggctgtggacctgcaggctatggctccactaccaggtgtggtacagatccagggggacatcacccaggtaagagcatggctgagggtgttggggtatatcctgggtgaaggcccttacctggggtctatgcagagtggaagagaaacagagaggtgatagaaacagagagagaaagagagtgagagagtaaccatggagaaacagtcagcaggtcatcattgcacagacacagcagaaaatgatgatgctgggtccccagaggtggagcccagtcttagagaggcaaagcctgggaatttggctgacccaggggctgtgggccaggaccatgggcaggcgggatctgagggcagcagtggagggccgtggggccactcatcctccctctctccatagctgtccactgccaaggagatcatccagcactttaagggctgccctgcggacctagtggtgtgtgacggggctcctgatggtaaatagcaacagaaagtgggaggccaggcggggccccctgtgtgtgtccttctctgtatctcccaccttggttgacttattcacctcttcagttactccctgcctctcccttccgcactcagctttctcccacatctggcaacttctccctacctctgctgcctgttctctctctgcctctctcttcctcccacttgcaccccaccctttgagtttcatgtctgttgtctacctttccctgctctcatctctctgcaactgtccaattccgttgcactgttcattcattttcagccagccagccattcaacacacatttactgagcacctattgtgttgggaaaacattcatgaataaaattccattaatctttaacctcatggagctgatgttctagtgggagcaaatgggaaagaaaataaatgattcagctctgtaccattaaaaggggatggggccaggcatggtggcttccacctgtaatcccagtgctttgggaggatgaggtgagaggaacacttgaggcaggagtttgagaccagccttgcaacatagcaagaccctgtcttaaaatattagctggcatggtgatgcatgcccatagtcccagttactcaggaggctgaggtgggaggatcacttgagcccaagaggtcgaggttacagtacactttgatcgcaccactgcactccagcctgggca[136 bp omitted]tatgatgaaaccccatctctactaaaaatacaaaaattagccaggtgtggtggcatgtgcctgtaatcccagctacttgggaggctaagacagaagaatcgcttgaacccgggaggcggaggttgcagtgagctgagatcgcaccattgcactccagcctgagcaacaagagcgaaactccgtctcaaaaaaaaaaggtggggtgggggatgggtaccatagggaaatcattgagcaggaggaaagcaggagtacctgttggaattttaaatcaagtggatggggaaggcctcactgacttaacagcagagactaaaggaggtgggggagtaagctatggatatgtctggaggaagagcaatccaggaaaaattgcagcccgtgcaaaggtcctgaggcaggagggtgcttgctatgtatgagtaatgacaagcagatcactgtggttggaacagagtgagggggggagagtggtaaaaggtaacatcagagaggtaacaggggacagatcctatagggcctcgtgggccatggtgaggctgttggcattttcaccgagatgagagcttggagaaaaccatgagagggttgtgaggagaagaggactgtgctgggcttgggctactatgagctgtgtgagggccaagggcagaagcaggggctccggggtggagtagtccaggcaagtgataatgggtgagggcagtggtggagaggagaagatcaagtcagatcttttgaaagtagatgtgttaatggcttcgatgtgggtgtgaggagaggatgcggggggagcatcagaggtgactaaggttttggatttgaacaattagaaagctcagatgagatggggaggatggtgggaggagcaggtttggggaggtaggtcaggagtttggttgtggatgtattggagatgtagaatctgatttgtgaatctggagttcagaggaacagtctgggctggaggtggaaatgataatgatgcttgtgtgtgaggttgttttagaattgaaatgagttcctaagggttaggagctcagaatatgcatccagttggcagacagtaatttgcatctggaaccttagcagtaagacagcctggaaaatgtatttagtgtctgatctgtgtggtacaagaagatgcacagagccagatgggacccccctaacgctgttcctcttgccacagtaaccggtctccatgatgttgatgagtatatgcaggcccagctcctcctagctgtgagtaaccctggccacccctgacccactttggccccctcctggctgtctccacctcagcctcagccgtctgtcctgcccacaggctctgaacattgctacacatgtcctgaagccagggggctgctttgtggccaaggtaagtctcaaggaacttggtggagtagagggaggtcgctgagggccaccctcacccgctgtctttgccttctcaccctgcagatattccgaggccgggatgtgacgctcctctacagccagctgcaggtcttcttctccagcgtgctgtgtgccaagcccaggagcagccggaactctagcatcggtcagtggggtggaggggccaggcaggcagagggggatctctgggacgccgactgcacgaggaggaagcggcagtcatgcctcactccaccttcccctggcagaggccttcgctgtctgtcagggctatgaccctcccgagggcttcatcccggacctgagcaaacccctgctggaccattcttacggtgagagctggagcatgggccaccctgggggactctgccacaccttatgcaatctaggtcccatgagggcccacagtctcaccccctgggggaggctctgtcccctcatgggaatttttttcccaaggggatccttagccccattctctgatggaaatcccacccctttatgggtattttgtcccgggaggagcttcagcccaggcagtcctctagtggtaactcttgggcctggtgaaaattccatcccaggaggatcctgagccctgccccagtggagactccacctgcctaaggacattctctcctaggaagatctcagtcatgtcccaggtggaaacctcctcggtgtgaaacttttgccccttaagcctctagcaggaagagacagagcctgcccctgggatgacatttgagtgagggagacgtcatccaggcagcatataatccaatatcaggtggacataaatgcagtgaaaaatagcagggcaccgatgttttagaaggggtgattatggagggcctccccgaggaggtgatctgaaccaaatgaaggatttctggtggggtgggaagagagtagctggtggatatgtggggagggtttggcagccataccgccgcctgtgtcatgactggccccaggcatcctgaccttgtcctcagttgtctccccctgttcctaagacccagatttcaaccagctggatggtcccacccgcatcattgtgccttttgtgacctgtggggacctgagctcctatgattcggaccgcagttacccactggacgtgagtgcccaaccaacagtaggtgggtgggagggaggctgtcctaggttaccaggtcctcaccatctccctacccctctgtccctgcagctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgaggtctggaaatgtgactctcagcctgccttgaccccttccccgtgtgcctttttctgacccaaatctcatggtttctggggccaaaattccctttcctgcctcccaatagctataaaaaattggtaaagccaagcataatgaatggaaaagtttcgccaaatatgtgagtcacttttctttttcttgggtagatggaagacaatgaaatgagttgttcaccttaacccattacggtaagtttgccttgttatctaagagtttgagtaagggcaacctttatgaaaaacctcagtaaaatttcacctttgaaatttttatgtcaactgataagattttaatcaacaaacccttttctaaacatctgttgttgtatgccaggaactgctttaagcattttacatttgaggcattcagtaaacatttattgagcacatactgtatgtcaggtgttgttctaggtttggagatagagcagggagcaaaacagaaatatcttggctctcacagtacttccagtttggaaaagaggcaacaatcaaaacagtctgtaagtgcaagagtttacatacacatatatactatatagcttgcatttctcaatttacatatcttgcaatatatataatatataagagtaatatgggatataaaaaatagaaaaaagtaaagcagggtgaagagaatcaggaattctaggcatggcagttttcatcttttggtgtttttgttttgagacaaggtctcactctgtcgcccaggctggagttcagtggtgtgatttcccgggctcaaaaaatcctcccacctcagcctctcaagtagctgggactacaggcatgtaccaccatgcctagcaaatttttgtatttttaggggagatggagttttgccatgttgcccaggctggtctcgatctactgggctcgagcgatctgccatcctcggcctcccaaagtaccaggattacaggcatgagccactgcgcccagccagtttgcactttttaaaagggttgtcatagaaggcctcagacattcctcagaggtaatgtttgagcaaagacctgaaggcactgccggagggaagccatgtgtttatctgagggaagagcattctgggtaaaggaaataggcatgtcccaaaggtggaactgcacgtggtatgggaggaaagtttatccatagccaaatgttctaaaaccacgatgttagaggatggccctttctgacaatggcatagcaggttattcagactaagtcagccatcacaaaaagccacctttttttttttcttgagacagagtcttactctgttacccaggctggagtgcagtggcatgatctcagctcacggcaacctccatctaccaagttcaagcgattctcctgcctcagcctcccaaatagctgggattacagtgcccgccactatgcatggctaatttttgtatttttagtagagatggggttttgccatgttgaccagactggtctcaaactcgtgacctcaggtgatccacctgcctcggcctcccaaagtgttgggattacaggtgtgagccaccacacctggccttttttgttttgttttttgttttgttttgagaacagagtctcgctctgtcgcccaggctgggtggagtgcagtggcactatctcagctcactccaacctccgcctcccgggttcaagagattctcctgcctcagc[134 bp omitted]caggcctcccaaagtgctgggattacaggcctgagccaccacacctggccacaagaagccaccttaagaaaaaattgaaacagcaaatcattgtgtgaaagagatttacagtttttaatatttaaagggtcctgtaaatcaataaggaaaaacatgagagtggccagtaagcacatgaaaagctgctcatcaggaaaatacaagtgaaaactcaaaatatcaacaacactaagtatttgaaaggatatgcagcaattgaaagcctcgtacatgctactgggaaggtaaaatggtgcagccactgtggaaacttaggcattacctactaaagctgcatgtgtg[134 bp omitted]caaaaccccatctctactaaaaatacaaaaattaaccgggcatggtggcgggcacctgtaatcccagctactcaggaggctgaggcaggagaatcacttgaacctgggaggtggaggttgcagtgagctgagatcgtgccactgcactccagcctgggtgacagagtcagactccatctcaaaaaaaaggaaatgagtcctagagtgttgctagcagcactatctatagtatatgcccattaaatcgtggtacattcaccgtggagaactgtacaacaatgacagtgaacatcctgcaattacaccaaataacaccttgtagttattcattaaactgaacatatataggttttatgcattttctatatgtcatggttcaccataaaaggaggaaatgtcacaaaaatgttagcagcagagttagctaggtgtggtggcacattcctgcctgtaatcccagctacttgggaggctgaggtgggaggatcacttgagcttgggaggttaaggttgtcgtgagctatgatggagctccactgcactccagcctgggtgacagagcaagaccctgtctctaaaaaaacaaaacaaaacaaaaaaactttctttgacttttggttagctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctcaattttgtttcaatttaatatatagtaataattgtaattcaatgtaattggcttccattgtaattgtgtgtgtgtgtatgtgtatgtatatacttttaaaaatattctgtgaaggggttcacagatttaaccagatgccaaagggttctgcagaacaaatttatttatttattttgagacagaatttcgctctgtcacccaggctggagtgcagtggtgtgatcttggctcactgcaacctctgcctcctgggttcaagcgattctcctgcctcagcctcccgagtaactgggattacaggcacccgccaccacacccggctaattttcgtatttttagtagagacggggtttcaccattttgtccaggctggtctcgaactcctgacctcaggtgatccacccacctcggcctcccaaagtgctgggattacatgcgtgaaccaccgcacccagacttcagaac[137 bp omitted]catagtgaaacccgtctctaccaaaaatacaaaaattagctgggtgcggtggcacatgcctgtaatcccagctactcaggagactgaggcaggagaatcacctgaacccgggagatgaaggttacagtgagccgaggtcgcgccactgcactccagcctggacgacagagtgagactctgtctcaaaaaaaaaaagcaatgtcagaaagtctacctggactgcagtcctaaatttctataacttaatgaacaggagctgacagaaactccccagctacacgaacagaactgttttctacagcttaatcctgtgtccttagaaattcacgtactctgtgatccaaggactatccacgccacagtccagtgacctcaggagtatccacataccagtctgcgaccccagctgtttccacacctgactgtgactcaccccagttaccatgtgtgaccccaggagtatgcacactcaagtctgggaaaaccattgtccaatctccagtcagaaatggtgtttaaattctggagcgtgtgttcataggcatgtctacactccggtctctgaccacgaaaataaccacaccccagtctgtgtgactccaggaatgtccagaccccagtttgtgtcagtctaggagtgtccacaccatggtgacttaacccaggagtcttctcaccgaagtcagtgtgaccacaggaatgcccacaccccaatctgtgaatatgcacagcccaagaatgtatggcggaagtgtccacacaaaaggccgtgtgaccacaggcgtagccacacccattacagtgcaaattcagcagcgttcacacgacagcctgtgagacctcaggagtgtcctcacgccaggttctgtgagtccagcagtggcaatggcttggagtttccatagccatcttagtggtgccataaatgtgtagctcaaacggtgaccacagaggagtccacagctcagtctgtggtgtcctgggagtggttttgccccagtccagccacctcaggagtgtccccacccaagtttttatgacacaagtaatgtccagttcccagcatatgtgaccctggtgttgtccaaaccccatagtctctggctattagtgtgtctatacccatcttgacggcctcaggcaggtgcactcccccatctgtacgaccagaagactatcgactcccctgtcattgtgaccacaggagtgtaaaactccagtgccagtgactactggtgggtccacattccagtctgggtgacccaggggagggcacagccctgtctgtgtgaccataggagtcttcacaccccagtgtctgtaaacacacaggagtcaattccccagtcagtgtgaccagaggaatgttcacaccaaattgtgtgaccacaggagtgtccacacctatctgcatgtcctgagaggtgtctatactccagtgggtatgacaccaacagtgtccacaacaaagtctgtgtgactccaggagtgtccctccccccagtcagtgggagtctagaaggatctacaccaagtcttgggagcccaagggtgtcccttcgccaatctttgtcactcaggggacattcaccccccagtcacacagacgaagcatatccacagctgggtctgtgtgaccccagcagagtctacttcacaagtcgtgtaaccacaggagtgtccccagacgaacctatgggaatccaggagtgtccacatcacagtcacttgaccacagtggtgctgacttcccagtttatgtatccttagccatgtcctttttccagactgtgtgaccctaagtgtccacaccccaaactcggtgatccaagtcactccagtctgcgtgactccagtgttgcccacacaccaatctgtatgaccctaagagaacacatcccggtctgtgatgcttcagcagtggccacaccctactctgtgtgaccccagaagtggctacaccacaatcagcatgacctcaggatttcttactccaaaatctagtaacatcatgagtgtctacaccctcacctgtgtgattccaagaggatccacaccccaggctgtgtgaccctgggaaggtccctatagcagtcagtgtaaacctgggagtgcactcttccctgtcagtgtgagctgggagggtgtatctagaggaagagtgatccagggaaaggcgaagggccggatgtggtggctcacacctgtaatcccaacactttgggaggcca[134 bp omitted]gaggcaggagaatcacttgaacctgggaggcggaggttgcagtgagctgaggttgtgccactgcactccagcctgggtgataggccaagactctgtctcaaaaaaaagaaagaaaggcaagggccctgaggcaatggccctgaggtgcctggcacatttgaagaacaggccagtggggcaggagcagagtgaacaaggagccagtggcgggcggtgaggtcaaggagggcccggagggcctcgtgggccacggagaggactttggctttttctctgagagagatgagagccatggcagggctccgagcagaggagggccccgggctgacttgggttgcaacaggatccctctggctgctgtggtggcggctactcaactgttattgtttgtcaaaactcagagaactgtatgccaaaagggtgaactttatcgtatgtaaattataactctttacatttaagttataacttttggaaaatgtgcagtactggccaggcatggtggctcatgcctgtaatcccagcactttgggaggctgaggtgggaggatcgttttagcctgggagattgaggcggcagtgagctgagatcatgctgctgccctccagcctggacaacagagcaagaccctgttttgaagaaaaaacaaaaaacaaaacaaaacaaaaaaagtgcagtactttgcaagcaataaagatttctatttctgcaagagaggctgtgctcatgcctgtccttacccctctccttcctgcacaaacacatctcaggaatgcacctgaggaaaaggagggagccggggcctccctcaactgctcaaggtagtgctccctttgttgtctgctgtgaactgaattgtgaattcagcaaattcctttgttgaagctttaatcctcaatgtgactgtatttggagatgggggtaattaagattaaatgaggccataagggcagggtcctaatctgatagaaccggtgtcctcattagagagggaagagatgcctgagctccctccctctctccctgtgggcgcacaaaggaaaagccacatgaggacagagaaagaaggtggctgtctacgagccagaaagagaagcctcaccagaaaccaaccctaccggcaccttgatcttgaacttccagcctccagaactgtgagaaaataaacgtctgtggtttaagccacccagtctgaggtattttgttaaggcagtctgagcagctaattggctctcagtttcaaggctgatttcaagagactcgtgttggccaggtatgaggggagccagtgctcaagtgaaggaaggaaaattcagcacatcctcctcgtctagctgaagggggctctggagcagcaggaggggcccagggcaagcctggaatgaaatccgtggcactcctgcaggttctgggggcggtgtccatggaatatcctctgccacataacaaaatgactaataattgcttggggagctttcagaactgccccaaggcttcctctaacactccacccacacctggttcatgccaggttgctcgatgccttggttcgggagaataggtgtggtgtcatctcaggcttggtggcagcccaagggaaggggcaagtgttctgagtctctctagatgacacaggagctgaggaaagctggagtgaattatgagtcacagcccgtacctcacaagaaagttctgcccgatgccagagctgggagccatcaccagttatgcagggttggtggagaagagcctcgggataattggtatgcatgcccgcacataggtgtgtgcgtaccagtacgtgtgaagttatgcaggagtgcgtggtgtgcttatgcccatgtgtgtgcacattagtccttttgtgcatgcatgcatacatggcacatgtgtgtgcattcatgctttgctgttttgaatgcaggtatggttataagtgcatatgggcaacagaagttcaagtgtgaattctcatggagatgctagggtgtagcaggcacatggggacctgttccctgacaggggtgtttgtgaaaagcaactgtgcatatgtgtgagggtgtacttatatatgagattctatgtgcaaagccctatgtccgtgggtgctagcctgagtgtttgtgtctgtgtatatacatgtgtatgccagcgtgcacatgcatggctgtgtgtgagtgcgtaagtgaaggggagcacattggcccaagctggtaagtctagtatctatgcatgtatacccctgggcaccgccccccccgccccgtgcaagtgtgagtgaacaggtacacaagggcctgggcgtagatgtctgtgcacatgtacgtgggcatgctgtatgcatggctgcagggatttcccacgtgtgtgtgtgcacagatgcacaagtgcccaggaacctagattgtggtgtctgtacacatgtacctctgggcaccatgcatgtgtgtgtgcaaaagtgcaagtgtgcctatgggctcaggtctggctgtctgtgtacatataccccctggatgcccataaaggtgtgagtgtgtactgcaggtgcatatttgtccgtgggcctcagtctgggtatttgtgaacatataacctgtgtgaacgtgcatgggtgtgtggatgtgatcaggtgtgcccatggacccaggcctcggtgtctgtgtacaggtacctcagggtgcccgtgtgtgtgtgtgtgtgtgtgtgtgtgtgcgcgtgtgtgtgtgcatgtgcatgtgtgtatgtgtgcatgtgtaactctggaggtccatgcatgtgtgtgcgcatggcttcaagtgtgtccaaggacctgggtctgggcatgtgtgtacatgtatccctaggaacccatgcatgagtatgctcacgtgttcagcggtgccaatggccttggatcttggtgtctgtgtatgtgtacccttgggggaccacagatggcattcatgcatgcatatgtagcaccatggagggatctgtgtgcagatttacctctacctacacctggctggggatcataaagaaaatcaagggatgcgctacctccatgaatccaggtttcagcagagctaagggagtgaaatttggggccattttacttgtctcaaaccttgttatctgagagaaagctagagcttccttctttcagcccccagagacaatgtggccaggctccggagggctgggaagatgagcaatgcttgtgagtcaccatgataggaagcagaagggtcaggaagtccctgggagcaaggcttagggttagggttagggagaaaacacttgggcctggaggctcggggcaggcttcctagaggggaggggtaggaagaggcagtgacagggcccacagcaatggagaggagttggactgcagggatggggtagggggacagacgacaagggacactcagaagactaatgtctgggagtgggaaaacagtgtttgctcagccaggaagctgcatccagctcttttatcatttgtagaagaccaagtacccaggcctgggaggagcccagagatgaaccagagtttggagctgggggcgggggtagttctctct[142 bp omitted]gagacccccgtccctactaaaaatacaaaattaggcaggcgcagtggcacatgtctgtaatcccagctacttgggaggctgaggcagaagaattgcttgaacccgggaggaggagactgcattgagccgagatcacgctattacactccagcctgggcaacaagagtgaaactctgtctcaaaaaaaaaaagaaagaactgtccaggattccacgggcccctggggcccagggtaagctgcctcccctttctgggcctcggtcttctccattgtcacatggcctgcctgtctgcagcccaggccccgggaagcatttagcctgagagaggagcccatggacagtgggcaggcagctggctgctccccaagattgggccaccctcctgctcctctgccacttcagagtctttacaccctgccccagaggcaaagcttggaaatgggctgggggagccatggccacaggccagtcagcatgggggaagcctggtggggttgaaaccctgggctaggagggggcacgtccatcacgaaccctggtcccccaccaacccacccgaccatagcaggggaggcacaggaacccacaaccttcctcctgaccccagctggagaaggatgttgctgctcctgaattccaagctggcccagatgtagagtggtcccccaagggtatacttgcacagacaccaagatccaagcccattggcacagctgaaaacatgagcattcccatgcatgggcccctaggggtacatggacacaaatctccccttccagtcatggcaccccagtcctgatcagcttcaccccaaaaagctcccaggtgcggagtcaagaccttcttgtgcccccacttcaaccccaagccaatggcttctttttttttttttttttccagagactggggtggaggggtttcactctgtcacccaggctggaatgcagtggcacaatcatagctcactgcagccttgatctcacaactgatcctccgtcctcagctactggtgcgagctaccacgcctggctctgagccaatggctttcttttagatcctccagaaggtcaacaatactgactgcagaacgccaggcagccacaggccactgggcacagttgtgcaggctgtgctctaacaaaagttgcctggccacagaggacactgggagcaggaatgcaccctgggctcctctagcatcactggggcctggcctggggccgcgtccatcaggaggaaggggcatccttttctaaagttcacgcaggcattatgtgagctagtggcgcccctcagtgtccaggtttttaaaggcaaaggaaatctggacatgcgcagaaagtgaacatggccccagagccaggcataccttcacccgggatgtctctgagctggaaaaaaatactcagccattgtctagcgcagccctatgcttatcaggaaaaattgtaaaaaacttttaaatggacaaaactattccccaggtgtcctttcaatggaacactggatgtggtctacccaagccccttatggcgtatctgattctatagcgggctgcacttttgtctttggctgggccattttgcacctctgtagagagaagttaacctgtgcaggactgataattcccatccataataaatgaattttgtcctgtagagatacagctgatctctatcctgtagaaaaagattattccagatattatattgcatctattggcaaatccattgcagtatctctgggagtttatatatgcttgttcttcagattctcctctgagcctagtgtaacatattaccagttccctcattcataaatgatctgggccaggcatggtggctcatgcttgtaatctcaacactttgggaggccgaggcgggtggatcacttcagcccaggagttcaagagcagcctgggccacaaggcaaaaccctgtctctacaaaaagtacaaaaattagctgggagtggtggtgagcgtgtgtagtcccagctactcaggaggctgaggtgggaggatcatctgatgccagggaggtcaaggtctgcagtaagctgtgattgcaccactgcactccagcctgggcgacagagtgagactctgtctcaaaaataaataaataaatgatctaaaaatccttgacacatgttcactttatatttgtaggagtcgtgatgttaccattttggaaataattttttaattgcatctaccagctcacagtacagatgagatcaccaagctgggggagaagggacttgcttgaagtgaccctcatggactgggactggaaggcagagctgaactcaagctactctgggtgctgccctgctcctggaaggagggggatatgctgtgcccaggtgtggaatggaatggagggctgtgacacacctccaccatggggatatggagtgaccttctgagatgagggggtcatctgtcaggtcccaccctctgtgctgtgccttgattcagacccacgacacaaccagccgtccaccccaccccaggtggtcctggccaggggaagtgctgaaatgcccccattgccatcctgaactgctatgctggtgatgaccataggaaagctttattctaggtatactatttcaactgctgggccccagcttccttatctataaaatgtagttagttccggttcctgccttatatgatgtggagaagattaaatgagattatggacacgaagctcttcaaattgcccggcacagagtaaacgctcaatatttatcagctgttagtcattaggtctgtttgacttgcagaacttccagtggtggacatttttgaagggatgcttggggccccctcgagatgctggcctagcaggacccagctgctccatccttggatgaaacacccaacaagtgttccccgggtgatggatcaggaaactcagactcctggccagggaaaacaggcctgacctgctctctggaacccccatgttgccatccaggagatcctgaagcccaaggcacaaatgaggaggagcacaaggagtggtgagttcttgacaggaaatggtggggtgccctaggagaaatcacctcttagggtctcggtttccccatctgtacaatgggcacttcggagctgtgagttgctgaggacctttgcagccgccttttggggaagaacaaatgttctccaagggtgtaacggctggaggctgaccctttcccagcccaggccctgccattagagacaaagtacaccagacacaaagggaaaacccagtccccgccacacaaaggcaaaacccagtccccgccacagcataggaagctgcccagcaagttgagagtcaagttgcccaagttttgtggccagtgaaggggaggtttgcagccagaccactcctgaggcctacctggggaacttgtgggggttgggttggggggatggactcagtggcctctggggtcccttccagtccagactctcctctgtggctggcatgctctgacctcagaggtccaatctgcaaaatgggacgataaccccatgtgggctgagagggcaggaaggtggatgtattcttcagggttctgtgagttgtaagtggcagacactccagtcaaaccagcttaaggtaaaagggaataattactcaggtaatggaagagacctgggacagagtgagctttggccatgcacagcgtgtctgaggactctctctctctgtccaggaggtctgatttatctttgagagcttggccctcggcaggctctcccaggtggtggctgcctcgcctatccctaaacagcaaggagtcccagaggacagcaaagcctctttcccttcagttccagctttagatcatgtggcctggcttgagtcacacccattcctgaccctgtggtcacaatgacagattgctctgattggctggtctagtcatgagtccactcctgaagatataggtgggagcagggaggtgggggagttagccccacaagaacaacatgcactggagtgaggtgaggaggaagggggttgctaaaagaaaatggaggtccagccgggtgtgttggttcacacctgtaatcccagcactctgggagtctgaggcgggcggatcacaaggtcaggagtttaagaccagcctggccaacatggtgaaaccccatctctactaaaaatacaaaattagccaggcgtggtggcacgcgcctgtaatcccagctacatgggagactgaggcagaagaattgcttgaacccgggaggcagaggttgcggtgagccaagatcatgccactgcactccagcctgggtgacagagcgagactgcatctcaaaaagaaaaaaaaaagaaaaaaaagaaaatggaggtcagacatgatggttcacatgtgtaatccgagaacactgggaggctgacttgaggccaggagttcaaaaccagcctagacaacatagtgaaaccccgtctctacaaaaaatacaaaaattagcttggtgtggtggtgcatgcctgtagtcccagctacttgggaggctgatctcttgagccctggagtgagaggctgcacctctcactccactgcactccagcctgggtgacagaatgagaccctgtctcaaaaaaaaaagaaaagaaaagaaagaaagaaagaaggtggtctttcatagaagaggaaagaggtgctgagttggtaaaaggaatgcctgcccaatacagtaggccaccgctgaatccttaagtaaaaccactggcagccttagtccctctctgcctaccactttcaggtgctcagctttatgctgtaaagttaccccatcactcctaaactcggaaattctgcctcccatgacagattaaaaggcaatttatactaaaatgtcaatgactaccagattctgaagaaggcaaagcctcactggatgtgacttaatcttctagtgagatttagggccgtgtggcaaaaggatggggagatgtcagggagtgtgccaagtactcaatggaccaggcagctcaaaggcagccccgggaggagagagcaacctccttcccatgttctgtctccattcagagcagatggccctcccaggcgcatctgagctcccggctcttctgctcccctcctctgagggacctgtctgtctagctatcagcctgtcagttcagctctgctgcaaagctgttgtgtaggtgtatattcatcgagtgtctgttcctaacactgatttcttggcagagagaagtcagttcatccaaccattaaggatgagttctgtgtgagagggtcagagaagaggattgggaagcagatggagcaggttagaacattagaattgttatcaacccgctctttcttgtagatacccacagttcatctactcaaccactcacttagccttgcgcccattcatccacccatgattcacccacttacccactattcattcatctgtttatctagccacccatccgcacacccacataactggtcactgctgtggctccagctttgtgccatgcattgggagcacagagatgagtcatatcccctcctgctctttcagccctcccagtctaactggagagacatccacaggcaaatctcgctgcatgattctgtgatcaatgctgtggttaccccagggagcatttgattatgaccctgacattttagccgagtgctgacagatctcttggtgttgccaggagagaggaggaggaaggacattcctagaagtgggaacagcgtagataaaccctgggaggtgtaagagagaatgagtgtggttaaagcgcagggtggatgaagggctgaggcagaagttggcacttgggctgggtgcagtggctcatgcctgtaatcccagcactttgggaggctggggcgggcagatcacctgaggccaggagttcgagaccagcctggccaacatggtgcaaccccatctctactaaaaatacaaaaattagccgggtatggtggtgggcacctgtaatcctagctactccaaaggctgaggcaggagaatcgcttgaacccgggaggcggaggttgcagtgagcaccaagatcacgctgctgtactccagcctaggcgacaaagtgagactgtctcaaaaataataataaaataaaagaagttggcatttggaagctgagcaggggctttaattcctagtcctggggtgccagggatggcttttgagcaaaagagccagcacccagagtgtggccagaggcctggggaagctggcctggggtagccagcccgcttttgctccaggccccaaagagacacatgtgccaacccccagcctgcaattcaaagaaagaaaaagacttcaggaagaacgccatttacagaaactgtccctgagatggatggacagatggacagtgggatgctgagatgtctggtgggtgtacagatccaagcataaactctggtccacaccacacgctttggggacacataccagggaaacaatgtggtcaggggaatcaggcatgtgcaccccaatttacctggctctgcagggcttggagggcttgcaggatgcatggccacgttgctgagggaagagggccagaaggtcaaagccacttccagttgggactctaagaatttcctcaagggggccgggtgcggtggctcatacctgtaatcccaacattttgggaggccaaggcaggtggattacttgaggtcaggagttcaagaccagcttggtcaacatggtgaaaccccgtctctacaaaaatacaaaaattcatcttgcgtggtggcgggtgcctttaatcccagctgcttgggaggctgaggcaagagaattgcttgaacctgggaggcaaaggttgcagtcagccaagattgtgtgccactgcactccagcctgggtgacagagcaagactctgtcttcaaaaaaaaaaaaagaatttcctcaagagcagcagcttctgaattttcctgagtgtagctgaatctttatgctaagaaaccatcccaagacctctgccaggagcactgggtgctgttagctctgtcgaatgatgttgtccttcacaaggagtaagagccaggaggacaattgaggatgtgtcctaagaatgacaccccgtgcaggggatggggctcagtagtgaaccaatccctctgcccagggctgccagccttccaggtgtcagacttggtcaggaaaagtcctcagccttgatagcttggtgtgagagtagtgcagtcagatctcagggtgccagaggaaactgggtcagcagatgatatgccaggaggccctagggtgccaggagctgtggagagacctcagctggctctagaaggaagaagggcagcagtttgcaggtagggtggggtagaaaaccaagggcggccgggtgcggtggctcatgcctgtaatcccagcactttgggaggctgaggcaggtgaatcacctgaggtcaggagttcgaaaccagcctgaccaacatggagaaaccccatctctactaaaaatacaaaattagctgggcgtggtggcacatgcctgtaatcccagctacttgggaggctgaggcaggagaatcgcttgaacctggaaggcagaggttgcagtaagccgagatcgtgccattacactccatcctgggcaacaagagtgaaactccgtctcaaaaaaagaaagagagagagagagagagaaccaaggacaacagggctgcagggtgaggaggacctccccaaaacccaaaagtcctatggcggccccatttcaagcactctccaggcagggagaggccagcacccagcccttcgtcacccctgctattcattggttgatggagtcctgtagtcaacgcttgccagacatcgtctagatgctgagcctagtgcaggcactggaggccacagacagcagagatgcagcactgcctagtggggagacagacacttttgtgtgataaggtttatgaagatagggtctgcccagggtgtgggaatcccagaagcaagaggtaggaagggtctccccgacctgggaagtgatatcaaactggatctttttttgctttattttagagacagggtctttctctgtcactcatgttggagtgcagtggcacaatcacagctcactgcagcttggaactcctaggctcaaggaatcctcccgctagagcctcctgagtagctgggactacaggtgcatgccaccatgcctggttaattttttctttttttctgagatagtctcactctgttgtccaggctggagtgcagtggtgcaatctcagctcactgcaacttccgcctcccaggtgcaagtgattctcatgcctcagcctcccgagtagctgggattacaggcacgtgccaccacacctggctaattttttttaatttttggtagagatggggtttcaccatcttggccatcttgaattcctgatctcaagtgatctgcccgccttggcctcccaaagtgctgggattacaggcatgagccactgtgcccagccaatttttaaaaaaattttttgtagaaatgtcgtctcactgtgtggcccaagctggtctcaaactgctggcctcaagcaatccccccaccttggcctcccaaagcgctgggattacaggcatgagccacctggcctggccggaactccatactgttttccacagctgttgcaccattttacatccccactgacagtaatttcccctatccttgttgattttatttatttttgaggtatttgaaacaagatggtttcaaaagtcagaactaggccaaaaagtctactcagagaggtgtcactgtcacttctccgttctatccctctcacccattccctctaggaaaccaatctcaatagtttctgctttatccttccaatgtttctttttgtaaagataaacaaatacatgtatgttttcttatatcatcttgtttcttacatgaatgcttgcatcctatatttacttttttgca[131 bp omitted]gtgaaaccccgtctctactaaaaacacaaaaattagctggacgtggtggcaggcgcctgtaatcccagctactcaggaggccgaggcaggaggatcacctgaggtcaggagttcaagaagagcctggccaacatggagaaaccccatctctaccaaaaatacaaaaattagcccggtgtggaggtgtgcacctatagccccagctatttgggaggctgagccaggagaatcacttgaacccgggcagccgaggttgcagtgagctgagatcatgccagtgcacccagcctgggcaacagagcaagactctgtttcaaaaaacaaacaaacaaaaaacagtatgtcctggaaatcgttcctcatcagttcatagatgtcttcctcaatcattttacagttgcacagaactccattgtgtgactgcaccacagtttattcaatcactgcctatgtataggaagtgatattgttttcaatattttgcaattataaaccgtgccacaatgaataaccttgtgcatttgtattttcacagtgtctgggggagtatcttcagggtaaattgctggaagtgggagcgctggtgcaaaagaaaaatatgcatttttgttagatgtcaaattccccttcatcggggttataaaaacgactttttaaaaagcacaaataagaaaagctgatctttgcaaaagaaaccaaacagtctttcttactgacatctaatagtctgcgttggttttaagactgaggcatttaatttcacaaagactgttttttacagagtgatttaatttcaccattgtcacaggctctgctggtgcctacgccacacacacacacacacacacacacacacacacacacacacacacgacctcacatcgccataggagctgcttatcccatctgagcctcagttgtagcctctgtaaaatgggcggcacctgtctggctacaagtggttttagagactaagcatttggttctctgtgagattccagatttcccagaaaatctgatgaaagctgagagctcgctccctaggaacatgctgagaaagagacaagcagcccctgacatcccagagctggcttgatacccacggctagaccttagtgccctcctgttgaacacggacaatttcacaaaacatcagtatcagacaaggccactctgactgtgatggatcgagacaaaaacaagatcagtatgtcatcttgtcttagcacagacacatgaatacattgtccaaaccacaaaaatgaccaagtattccccgacttggctatacaatgcacttttttttttttttttggccaatgacaactttagcctccactctagttagtctgccctccttctagataaaatttattgtgatatccaatcatagaattagccccactccctatccagagcaaagccctgcttccttaaaccatcccccaaatcactgaacacaagccccaatcctattataagttctaactcccttttactgagacaccccacggttccccacagtgtacaccctcccttgttgcaatgagcaataaacccaacttgttcaaccacacatgtgttcctggggggttttggctagaggactttgacagcacttacagagttggctgtaagctcaaggactctttggaaccccatctctgcatgcccctagtccacagactcctaattaagtggccttgagtctagagcatcagtaataccattaaacagatggagaaaccgaggtctagagagattgacttcttcaaagtcccattgtgagccaacagctgggtaggaactggaaactgtggctgctggtcccaaggtgaggtatgtccagcagacatagaacccgtccccaagctccccttggccacaacagtgttctccctgcacaggccacagaactaaccggcaagatacgcacatgcgcatttctgaaggatggcttcattctctccctgtcctgcctttctctctgtagaatggggcagtgagatcccaggttgagggataaaggaacccccacaccggggctaccctcaaggacgctcacacactgtggtctcagcttaaaggagcctcatcttccctgtccagctgctgcgtcccagagtgtgcaccctcacagaccctgtcaccagtagcacctcattcccatctctcaatttccctctgcatttgcccaggtcaggcgagctacctagaacccccctcccttcctttcttgaccttgagttctcataatttttcttcgagatctagcgtggggccaggcatggtggctcacacttgtaatcccagcactttgtgatgtggcaggatggcttgaggccaggagttcaggaacaggctgggcaacatggcaagactccatctctagaaaagaatttttttttttttttgagacggagtattgcagtctagctctgtcacccaggctggagtgcagtggtgatctcagctcactgcaacctttgcttcccagattcatgcgattctcctgcctccgcctcctgagtagctgggattacaaggcgcccaccaccacacctggctaatttttttgtatttttagtagagatggggtttcaccatg[139 bp omitted]ggcaggaggatcacttgagcccaggagttgtaggctgcagtgagttatgattgagccactgccctccagcctgggcaacacagtgagaccctaacaatcaatcagtcaatcaacaaaataagaatctggccaggcacggtggctcatgcctgtaatcccagcactttgggaggctgaggcgggtggatcacctaaggtcaggagttcgagaccagcctggccaacgtggcaaaacccgtctctactaaaaatacaaaaattagccaggtgtggtggcgggtgcctgtaatcccagctactcgggaggctgaggcaggagaatccattgaacccaggaggtggaggttgcagtgagtggagatcacaccactgcgctccagcctaggtgacagaacgagactccgtttcaataaataaataaataaatataaaaaataaaataaaataagaatcttatgagtcccagagagagagagagagagagacaaagctcttcctcacagtaaaatcccaggtatatgtgtaaaagaaaaatcattatttggccaccatcagagtagttattgcttcaggcaagaatcaccaatgaatgctaaagtagtgagtaaaagtttgatttaaaaaaaattgcagagttacagtctcaaagtatctcccgaaaagctacttattaattacaaaaggggatcatgcctgtaatcccagcactttgggaggccaatgcaggaggattgcttaagcccaggaatccgagaccagcctgggcaacatagtgagactgtttctacaaaaaatttaaaaattagccgggcatggtgactcacacctgtagtccttgaagattacatgagcccaggagttcaaagatgcagtgaaccatgattgtgtcaatgccctcaagcttgcgtaatagggcaagaccctgtctccaaaaaaaaagaaaaaaaattacaaagggaaaaatagtaaatttatactggtgaaaactagaagaccactttaagcaaaagatcaatgctaatactaacaatttcgagactaactgaaccctcctgcctcctgataacgctgagaacacagcgtcacttctgtggaattcctgccaaaaatgcagaattcaaatctaatcatgaggagacatcagataaacccaaattgaaggacattcttccaaagaactggtctgtgctctcccaaaacatcaagatcatgaaagttaagtgaagatggagacattgttccacattggaggagactaaaaaaacctgataacagaatgtatcttgtgaccctatgattcccttttcctatacaaggacactattgacatgcccaccagggtggctagaaccaaaaagtcagataacaagtatttgtgaggatgtggagcaatggaaacctcatactatgctggtagcaatgtaaaaaaagaaaaaaaagtccttgctcttaggatattcatactgaagtatttagttaaaagggtgtcatatccgcaaccactaacaaataattcagaaaaatcactgtatatcattcagaaaaattatatatatgtaaattacatatgtatatacatggggagaaagaaacggacagagacagagagagagcaaatatgttatcattataaggcttggcatttttgtcagtcccataagtgaaaaatagtatatcattgtttttaatttgtatctctttaattatggagagctcatctaaaacaccccagaaaccacaacctagaatgaccacagacatttattgagtgtccaccctctactaagctccagtgataaaaatatgaagcacaacatctggtagatgtaaaatggtattatatctcactgttgttttaattttacatttccctgagcagtaaagagattgggttatcttttcatatattatacatattgaccattttaggtttcttctgctgtgaattacctatttgtacccaatgtctattgccaagtgtattgtttgtcctcttcggatttgtagatgttcgttatatatcctaaaacctagatcctacttctttgtgacacaggtcaaaagcctagatggaaacaatcaagtccgcaaagcccaggagcacatgtggtaagaatcttccagttttaaatgccaagtcttgcaattgagggaagtatttctggtaggtgctgtgggtcattgttgactcaacttgagtgggtttgacaactgagaaaaaaattaaaatgaaatttaattcataaaatgtatgtcctgtattctgctgttaaggaaaagaattgatatttgtgcatctggtctaagctattattccttatatatacatattcttaccgtattaaatgttttttgtttgtaatacatgaatactaatttatgagctagaactccatttaacttcatgttaaaatagagagaaaatatacatttctcttcaattaccattggtgtttcccagcaaaaacctgccaagcccactcttttgtttaacagaaaaggacaatggagacgggtgagtgaacatgacttgcccagctccatacaggccattgttaatctgattaaaatctgtttcagttggctgcccaggtcagggtggcgtccagtttgacctgggcttccttctcccttccacgtcacagctaagcatgtagtgcagtaagcgcccagtaagtgctcttttggaaaaataggcccttcatcagcctaggtacaaaggggaatgcctagaaactgcagcagtagggtaggtagaaggcgggtgctacataaatctttagtgttggtgcagatagaggtgcggatggggccagtgtaagcgctttcttttttattttatttatttatttatttagagaaggagtttcgctcttgtttatttatttatttattttggagaaggagttttgctcttgtcacccaggctggagtgcaatggcgtgatctcggctcactgcaacctccgtctcctgggctcaagtgattctcctgcctcagcctccggagtagctgggattacaggcgcccagctaaattttttgtatttttagtagagacagggtttcgccatattggccagcctggtctcaaactcatgacctcaggtgatccatccgcctcggccttccaaagtgctgggttacaggtgtgagccaccacgcccagtctttatttatttattttgagacggagtttcgctcttgtagcccacaatgacgcgatcttggctcactgcaacctctgcctcctgattctcctgctttaacctcccgagtagctgggattacaagcgtgcgccaccacgcctggctaatttttgtatttttagtagagacggggtttcgccatgttggccaggctggtctcgaactcctgacctcaagctatcctcctacccttggcctcccgaagtgctgggtttataggcgtgagccaccgagcctggcccttaagagctttataaatgccccccttttaagtgctcggtactagcctccctctagttcacagagaacatttactagtcgctggggtcaccttcgaagcaaagagtctgctggggaattaagcatgcaaatcacttctcaacgacgacacgccaagtgctcacagctcgtccccaggggaagcacaggcgcctaatttgtgttcctaggtgacacagtcattacttataaatgttcctggccggtcccaggaggtgggagggttgggagttacttcggttctctcaaaggttggggaaggagagatctcggtttgttttcccatctgtgaaacggggacaccacggtatttagaggacgtgcgcgggtgactatttgggggtgcagcggcttccctcctccctcccccatctttcccttctcacttccaaggcttggaaatttggagattcggaagtttgttcttggatggccagaaatcctccggaggcagacggtctggggctgaaaccgccacaggccggaaaggtgcgggcgtgaacgtcctgcgcgccgacgtccccccgcgccggtctcccctcaatcctcctgctcccctcctccgcgtccccgtccccgcccccctcctgctctcccattggccgagccggcggccgggccgccccgggatttaaagggcccgctcgccgcgccgctctgggagccgctgctggtcccggccttgcggcctgcgggggaggctgcccggaggaggcagcggcggcggcagcgcgtcctcggtccccaggaccacggcttctttcctgccaggtaggtcgccagtagtgcgcacgcggctccccagctcccatccctgggccggcctccccaggcggatctgtagcgcgagtgctaggaccccctccccatcacctttccgactctccctcaggctatgtctcctaccaccacctccttgcagcccccggacctgggcaggactttgttggcggcctctcgccgggtggggatgagatggggggcgcggaggatacaggacaccccccctccccgtgccgccgcatccatacaaggagagatgcacacggcccccaagtgtcacagaatccccctctctgccctccactcagagcgactctaccttggaaaccagggattccccttcccgtcgcccgccccatttgatatatgggcctgaaatgtatgccatcccatcaccatcggactggactgttcacagcactggagagacagaggtccttcattcactccaggtcacaggctgtgcgtgtgcatgccgaacacccacatgcacacagttggtggctcagtctgatgtacctgacttctcacgccttcccccagtcctccagtaccgtgcctctacatgggctgggcagccccaaactgaaatgtgagtgccagagtgcatcctttaagcgaggtctgccccacggacacccgctccctctgtgtccctgctttgacagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcggtaagtgcctgccataccgtgtgccaccatgccaggccatatcagacctcccacattcatccatatcgagccacaccttaccctgtcacatcctgccaggccctagcatgtccaagctggaccccaacatgttcagccccaccacatcccaccaggccaaaccccattccaccataccacatcctactatgccagccaccccatgccatgccacaccgagccacatcctgccatgccaagccatgcccttcagtattcctgagttctgggattccagaaagctgagattcttggatcttgggattctgaaatgtctacatcccaaggttataagacattggcatgctgatgtcacagggttatggaatcccaaagtaccatgattacagcgtttggagattctgacaatttgaaattctcacattctagacttctaaaatgttggcattgtggatttctataatcagggcatgatgcgatttctggattctaggattctgaaatgtttccacagtcatagcaggcctgtatcttaatgaaagattccaagtccccaagattcctataggaggcggagatttctggaaatctgagatccgaaggttctacactttcttttttctttctttcttttttaattttaaatggatgttctattttttcccaggtttattattttgaaatttttcaaagctactgaaatgttgaaaaaatagtacagtgagcacccacgtatgcatcaccagattctctgtcaacatcttgccacgttagctggctctatctgtctatctatctatctatctgtatatctatccatctatctatctatctatctatccatctatctatctatcatcttcctgaattgcctgaataacctgctgacatcatgacactgtaccccacatccttcagtgtgtggcccctgagaacaaggacatcatctcccacaaccacatcctccaccatcaccccacaagacattgaatctggatacaataatgttatcctatataaattgatatttgaatttcttccaaggtcccccaaatgccctttatagatgtttcttttctttaaacccaggccctgccaccctctccagctccccaacacctgctttgggcccctccaatcccactacattccagcctgaaggcctttgccctggctacgccctctacccaggtcatcctccccttcctactagcccaccaaccttctctttcttgttctccctctctctctccctccctccctcccttcctcccactccctctctttctctctctttctcgttctctctctccctttctttctccctttcacccaaagggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatggggtatgagtatgcatccttatcctcacactgttggctgaagtgcatgggtgggtccccaggccccatatgaagttgtccaagacagggagggtggtgagattccccggagaaagaagggagtctgggagaatcatttgcctatgaggagacacagaacaggtaggacgtggagtgtccctggagaagggaatctgggagatttgtcctttcacaggactgtaagggacaggttgggcatgggctccccctggaggagggagcctgggagaatttttccaccatgagactgttgtaggacaggaggaggtagaaccctctgggcaccttggacccccttcccctgtcccccatggtctcagaggccatgagtgtcatgggaccaagaccagcacctttttcctcagtgagatgcacatggtagacaccgtgacatggcacaagatgcgaggtaggtagccctgcccctctcacctgcccaacccccctgccccactcctcgtctcctaactgcccccaccctgtgcctttcctctcctgcttttctccctcacctgcccaccccactggacgtgcagacctcacattactcttgggtccgtgtctctttccaccgtgcattttcccgaagtctgtctgtctcgtgtcatgtatgtgcctgactctctggagtaagggcatctatctgtcctgggcttccttgcccacctgcctatctgtcccatgcccacctatccatccttgtgcccgcttttcctaccacatctcacctggtgcacctcctccttgccatgctgatctgctctctgcccatccacttgaccatgggcaccacacataggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactggtgaggtcctgagtggatgggtgggcagggactgtgggagccaccctggggcagcactcatggagtgcttgatccctacagagctgccggtggctgcagaaggtggcccggagcctggcactggccctgctgtgccttgtgctgtccacttgcgtgggcccctacctcttcccgtacttcatccccctcaacggtgaccgcctccttcgcaagtgagcacagccttcgaggcccctgcccagcaatgagggggttgggtagggacccgcggtttccccagttctgagcctgtctcttaatgcttctttctgtcttctgttactacagcaagaaacgcaaagccaggtaaatgagggcaggtgtgagggcacgtggagtggggctgacatgagtgggggcagagcccatgaccaatgggttctgtgtgtccaagtgtgtctgaccgtcaactccatgactagacagagactgtggttggctggctggctgacgaagcttggctctgtgactctgtttgactgacactccaacacatactgtctctggctgtccatctgttcagctgtctcgctgttagaagcaagtcatattaactgtcatggagagtgacaagtatgtgttggttgggtgactttaacctgtcagtgactctgtctagggatatgtatgatgtatgtttgtctattggccactgacccccgaatgtaagcctgtgtggctgtctggctgtgccatcatcagtgatagggtatgtggctgtcattggataagataaatctgtgttcaagattctgactttttgtagctttggccaggaatgggtctgactgtggcatgtcatatgcctgtctgtggagttcatggactacctctgcctgtgtgtctgccttccctgatggcttggtgttgtctagctgaggggttgtacccgactctggtctgtgcctgtctgcaggactgactgcctctagtttgactatagggtttgatctggctctttggttgtatggcccctcccctactccctggctgctgattaggtctaatgccgaatgagtctccaaaaggtcaagtgacttgaccagtgtcacccagctaagcagccaggcatgaatcccaggcctaacttcagaacctatgctttttccaacgcaggatgctgcctgtttttgaccatgtctgattacaactagtagggggggtgtgtgtgtgcacagcagggtgtttgatggtctctgtgcccagctcagggatttttggctgtcctgtagtcgctgagtcaggttagagcattgcaaggctgggagtctgataagatttgtgtctggctgttagagggtgcaggtctgtgaagtcgggcctctgatggtggctggctttggccgtctggccacgtgagcctgcagggccatgccatattataggatagctcatgcatccatttgagccacataagactaactgcctgagggtggatgtctgtgtgtgactatcatagttcaccttttttgtggctacatttcatctgtcttgtctgaacaattcagaccagcctccagggcctctctgactctcttttctttcttctctgctgccttcctgacccctgggggccctaggggcaccatggtaaggtgagtctacagagcggggcccaggatgctgacatgtggtggggtatcatgttgggacctgaacgtgatgcctctcacccctgcccctttctccccaggtggctgcgagcctacgagagtgctgtctccttccacttcagcaactattttgtgggctttctttccgaggccacggccacgttggcgggggctggctttaccgaggagaaggatcacctggaatggtgggggggcttggggaccccctctcccacagggtgctgcctagaggagctgcagggaggagggcgggtgctcccaggggagggaacggccaagacagaagtgtggcggtcagatgagttgagatcccaaatggatttgcatatctcttctgcccccagggacctgacggtgtccaagccactgaatgtggagctgcctcggtcaatggtggaagttgtcacaagctggaacctgcccatgtcttattggctaaataactgtgagtcaccaagtcaccactccagctgtgttggtaatccaggccctttcatacattcatacaacatttactgagcaccttctgtgtgctaggcacccaaaatccctacccttgtcgagctgcagttctcctgggggggcagatgataaatacgagaaaaaaaatacataatagctcaggtgttgataagtgctatggttaaaaaaaaaaatttttaaaaaagcaggtaaaggtgatccaggagtgctggcaggagataggagtggggagggtagggtattgcaattgtaaaaaaattagccagggcaagtctccctgaggaggtgacattggagcaaagatgcaaaacaggtgagggagcagggagcgcagatatatgggggaggattgtaacagatgcggggacagcaggtgcaaaggtcctgaggcgggaacttgcctggtgtgtggggaacagcaagaaggccagcagggcaggagcagagtgagccagggtccagtggcaggcggtgaggtcagggaaggcccggagggcctcatgggccatggagaggactttggctttttctctgagagagatgagagccacggcagggctctgagcagaggagggccctgggctgactcgggttgcagcaggatccctctggctgctgtgaggacagactgagaagagggatcgaggatgcagcagtgaggaggccgctgccatcatccaggccagtgatggtggtggtggcagtggatgtggagaggagagctcagattctggcatattctgaaggtggaactcacacaatttgctgaatttggatgtgggagtttggggagggcaaatcaagggtaattcccaggtttttgccctgaggaactggaaacgtggagttgacattgactgaacttgatgagactgggaggagcaggctgggaagatcgggagctgggctttgggcatgtgaagtttgaggccatctaaggactttatcctgggggctccaacaggttgtgggtattctcatcctgctgatggccctccaggaggggctgggggactttcaggagaattttatcccacatctcttcccctccagatgttttcaagaatgctctccgcctggggaccttctcggctgtgctggtcacctatgcagccagcgccctcctacatgtgagcagggtggagcaggatcagggtggaagctgggtgggggcgggtggcagggcctcttcctcactcatttcattgtcatctgcattcccccagggcttcagtttccacctggctgcggtcctgctgtccctggcttttatcacttacgtggagcatggtgagtgcagggcccagcccagccgttggatagaaggttggtgggggggctggagacagcctcccctgaggctaacctgacccccttacctctccccaccaccctagtcctccggaagcgcctggctcggatcctcagtgcctgtgtcttgtcaaagcggtgcccgccagactgttcgcaccagcatcgcttggtgagggttcagcctgggcaaccttgtgcccaacactccctgtcaaaaatgttccttctatctctatcttgtatgtgtctcagggtgcccaccttcttcttttggtgcctgagccatccccataacctctcctctattcgctggcatccgtttccctaacaggcatttatcgagcatctgctgtatacacacctggcattcgtttcccccagtgaacatccgttgagtgcctgttggtgctctaggtgctggagacacggtgaatgaaacagactgaagtcccagccctatgggacaaacattttaaccgggcagacagtagataaaaaatgagtcagtaaagtctaataatagtgtgtcagattgcaagtagtgctaaggagaaaatgtgtagggcaaaggggacgggaagtatgggggtgatttccatttgaaatagggaggtcagagaagcctccctggtgaggtgatgtttgaggcctttaaccgaaggaggtgagagagggaaacgttccaggcagagagacacccagtggaaaggccctgaggtaggagagggcctggaatctttgaggaatagcaaggcagccagggtggcttgagcagaggtagggtgaggaggggagatgggtgggaggcatgggccctctagatcatggtggggatttggttttgttgtgtgtttttcattctgtttgcaataagaagtacagacaacttcatacttgtctcccacccaactcccgttcattactataaagccctgactcaaagccctgccactcttcctcctctgcctggagactcgcacctcccccaacccaggatgccctcactgtgaacagtaccctcatcttggatgcctctgcataggaggctccctgaaccatctcttccctatctcagggggtaccctgggcatcctcagtcctggaacccactgtgccctgtgtgtcccctgggctcccccgtgcaggaggaggtgggacacagtgagtaggtccagttgccaagtatatccatctgtcccccacagggcctgggggtgcgagccttaaacttgctctttggagctctggccatcttccacctggcctacctgggctccctgtttgatgtcgatgtggatgacaccacagaggagcaggtgaggtggggccctgggctgtgtggttaaccaagggtggcgctatctggcggggggaaaccatgaggacaaaggctgggaagctgaggcctgagctcctcagactgtgctgcttcgcctgggcagccagtgctcctcggtcctttcccatagtccctctgcttgagtcacactgttaggtcttttatttgggtgaagtgtgcaaaatatgtttatttattttacttataaaataacttttaggctgggcatgctggctcacgcctacaatcccagcactttgggaggccaaggtgggcagatcacttgaggtcaggagttcaagaccagcctggccaacctggcgaaaccccgtctctaccaaaaatataaaaaattagccaggcgtgatagcatgcacctgtaattccagctactcgggaggctaaggcaggagaatcacttgaacccaggaggtggaggtcacagtgagcccatgccactgcactccagcctgggcaacagagcgagactctctcaaaaaaaaaaatcactttatagagatggagtggaaaatccaggttttacttgtgttaattatttcacttcattattgtttaggtagaatttgcaagacttcttaattttttttttttttttgagacaaggtctgtcacccaggctaaagtgcagtggtgtgatcacggcccactgcagcctcacattcctgggctcaagccatccttctgcctcaacctcctgagtagctgggactacaggtgcatgacactaagcccggctaatgtttttttaattttttttgtagagacagggtctccctatgttgcccaggctggtcttgaactcctaggctcaagcaatccccttgcctcaacctcctaaagtgctaggataacaggcatgagcaccctgttttatttaatttaaatatatatatatatttttagacggagtcttgctcttgttgcccaggctggagtgcaatggtgcgatctcagctcactgcaacctccgcctcctgggttcaagcaattctcctgcctcagcctcctgagtagctgggattacaggcacgcaccaccatgctgggctaatttttgtacttttagtagagatgggatttcgtcatgttggccaggctggtcttgaactccaggcctcaggtgatccacccgcctcagcctcccaaagtgttgggattacaggcgtgagccaccacgcccggccaaaaaaatatatattttattttacttaggttgagtgtacaaaccctggattctgcactttaaaatttttcgttaaaatgtatgcactatttttgttcatgttgagtatgcaaataccagattttactcctttttaaattaagaacaatttaaaaataacatttattcatatggctcttgcagaatccaggtttttgcttctcttttagttaggtttcagtcaaaaacaaaactttgtgttttttgatattaaaaagtttttaattcaggttaagtgtgcaaaatctgggatttgcttttcttttttttttttgagacacggtctcactctgttacccaggctaaagtgcagtggcacaatcatagctcactgcagcctcaaactcccaggctcgagcagtccacccacctcagcctcccaagtagctgggactagagatgcatgccaccacacctggctttttgcttctttttaaataaagtttttgttttgttttcattaaaatattttaaaatagtgaatgcctatcatgtgcttcaaaaaccaaacagtattcaagatatttagagaaaagatttgctcccaccctctgccccctaccctcttacaggttacatggtgagacggggtttcaccatgttagccaggctggtctcaaactcctgacctcaggtaatccactcacctcagcctcccaaagtgctgagattgcaggcgtgagccaccgcactgagcccacttttatccttttattaaaatatctttccaaaatttaagcatatcaaacaaatataaaaatatattttaattctacccccttgccagtttttaccctaaagataacacatgaatgatactgttctgcaatttttgaaaatcttccacatcaggatatagtgtcctcattcattttttccactatgaggaagtgacacagtttattttttctcttatttgtggacatcaggtaatttctagtcctttcctattgcaagtgatgttgcagcaggaactctgtacccaagtggatccacacaggtgtggacagatctgtaggatctgttgatagtctcaatggagtagtacttttgtgctctcccaccagcaatgcctgaatgtgcctgctgccccaccagtacagagtgcctctcagacttcctggatatgtttgccacttcaataaagaggaagatggccgggcggggtggctcatgcctgtaatcccagcactttgggacgcccaggcaggcagatcacttgaggtcaggagttcgagaccagcctgaccaacatggtgaaaccccatctctactaaaagtacaaaaattagctgggcatggtggtgcagcatctgtaatcccagctactcaggaggctgaggcaggagaatctcttgaacctgggaggtagaggttgcagtgagctcagatcgtgccactgcactcaagcctgggtgacagaatgagagcctgtctcaaaaagaaaataaataaaatgaggaagattattaatgaggctgagcatcttttcatatgtttaagagccatttgtttttcctttactggaatgacctattcaccttctctggcaatttttctttccaaaaaattaatttttaggagctctttatatattagggagataacaggtcagagaatgggatcactttgtttttaaaatgatttttaaagaagaagacaaaaactatatctggtcacctttcatatgtacctaggcccttctgcggggcctcgcctagagcagtcacagaaatgtccttgggcaaaggatgggttttcctaagaacttctttgtccttgctaagtgggaccatcacctctttctctcccacagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggcttcttcttcactgctcagaggggaataggaatgagtgaggaagggagcacagcatggataaaggtttggaagctggaaaccatgaagagagagcagactgtgattggttcatggttagtttatgattgattagatgatgagcctgaagatggcaggatcctggtcctgcttggtttgatcagggcagggacagattgcatagttggatgtgggggaggcctgattggctggaaaactgaaggatccccattctgattggttgctctgagtgggacacagaggagagaaagcaagagagatgaagggttggtgcctatttatccttaggactgagggttgtgggttctaattggatgggaggtctgggatgggtctggattctgattgattgctccatctgggggcccactggtggttaggcgtttgattggctttttagaactggcatatggagattgagggtcttcatgccaattggtcagtaggactgagaggcctgggttctaactagttcttctgacttgaggtcgggagaagagagaatgaccgctgctattaggactgaggagttctgagcactgaagagctggggagggggtggttgcagtgtatagcgtgtgatctgcttgtaacagtttcgttgcattatactaagggttactctacctagaaaagggcggaggtgaaaggatgcaacgcaacgctaatttcaccagcggaagaagcgggtacagaccttaatgagtccccgttttgatcgactgataagggaatggggaaattgaagccaggactcgatgcagattggctacggatccaaaacgcccactaaccttggcgcgtcccagtctccaccccaaacctaactcaggtgaaaatggcgccacgcgcgggggcggggctagaggtacaaagagagtgtctattggttgggagcggcacgggccgccttcttcgcttcaccattggctcgctccgtaaggcaagagaacccactaggggatgagcccgaactagggatgtgacagagcgcgagacccagcctaaagagagcccggagccagcgtgggaggccgctgccgtcgcgcgccttggtgagtgccctccacccggcccctgctccctcccccagctctccccggctacgcggccagccctcggcgtgccagcgcgagaccctttgccacccgccccccccaccgcccttttgcgcctgcgcgagacccccagctaccgcacggttgtccagaggacagaagatccgtcttctcattgggcagcgggactggagggttctggttcggattgaccggctttgtgttccgttctagcgctgcacgccagacaccggcctttcaatatccgtctcttccctgcaggttgacggcgttgcacgctctcgcggggaggctctggctttccaaacgctggcaccgagggttgtagttctgattcgttttctttcctctgtcccccagttgcagttttcaggactacgtgggggagggaatagctttttgttgaacggtttaagacgctgacctgtgcaactggaccacgcctggttcctgtgtctcttaccaaaccgtgaccccggagcacaggactgggtttggtggtcgtgagcagtttgtgacccttgaaggaagacaccaggcctggtcctgtatctccctcgccagactgtgaccagggagggctgggatcaggtgttgttcccatgtgcctcccaccagactttgacccccgagggctgagaccgggactgtttctaccacatcataatatggcttctaaagggctggaacaagctttcagcctttctgtggccttgtgtttcagtcatgttctttttcttttcttttttattttattttgagacagagtctcgctctgttgcccaggctggagtgcagtggcatgaccccggctcactgcagcctctgcctcccaggttcaagcgattctcctgcctcagcctcctgagtagctgtaactacaggcgcacgccaccacacctggctaatttttgtatttttagtagagacggggttttgccat[140 bp omitted]tggtcactgctcacttcagccttgaagtcctgggctcaaagcgatcctcctgcctcagcctacctactagctgggactacaggcctttgtcaccacacctgactgattttcttatttttttagagacagtttcgctgtgttgcccaggccggacttgaattcctggcctcaggtgctgctcctgcatcagcctcccaaagcactggaattacctgccac[221 bp omitted]gaggcaggagaatcgtttgaacccggaaggcagaggttgcagtgagccgaggtcgcaccactccactccagcctgggtgacagagcaagactccgtctgaaaaaaaaaaaaaaaaacggaatgtaattagaagtgttacaatcctgtctgttaactggtaaattcggtccatttacatttctcatgataataaactatttgaatttgattttattatctcattctgtactttctatttgtccaggtttttctgttccttttttttttttttttttaacttcctgcctatacacacgcagccatcagcccacaaagacatgactaccaacgcgggccccttgcacccatactggcctcagcacctaagactggacaactttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctgtgagtcctgatttctttcatatgctgtgggatgggatttgctgggcagggatcggcttgcatgtttacctatccacctattcttcttccattgatttattttaaatttttatttaatcttttaaaaaatttattataggccgggcacagtggctcacgcttgtaatcccagcactttgggaggccgaggcaggtggatcacttgaggtcaggaatttgagaccagcctggtcaacatggcaa[133 bp omitted]aaccccatctctactaaaaatacaaaaattagccgggtgtggtggcacacgcctgtaatcccagctactagggaggctgaggcaggagaattgcttgaacctgggaggcggaggttgcagtgagccaagaccatgccattgcactccagcctgggcaacagagtgagactttgtctcaaaaaaaaaattattatgtattgttattattattctttttgttttttgcccttctctaaaactggtagataacttatttttgagacaaggtcttgctctgttgcccaggctggagtgcagtggtatgatgattgctcactgcaacctccaactcctgggttcaagcgatcgtcttgcctcagcctccccagtagctgggactatactataggtgcacacctttatgcctggctaatattttcacttttttgtagagacaaggtcttgctatgttgctcaggctgttctttaactcctgggctcaagcaatccttccacctcagcctcccaaaattctgggatgacaggtgcgcaccaccgtgcccagccttatttaacttttttgttgcatgtatattcacgtgggtcaaaaaaccatttaaagagatttgcagtgaaaatctgctttctatccactaagtttccccaaacgctgttaggcactgttgatagttgtttatgtttcttttcagtttatttacacacgtaagtctcaatttgctcaattgtaaaaggaggataatagtaataaccaactatatgtaagatacttagaacagtgtttggcaaacagtggttgccatgtaactgttcactattattatcattatttgcacttttccctttttacacaaatggtaatatgctatatatacttctaatcttttctctttttctttctttccttacaagaaaaccaaagaagccattttcttttttgagacggggtctcgctctgtcacccaggctagagtgcagtggcatgattatagctcactgcaaccttgaactcctgggcaatcaagcaatcctcctgcctcagcctccctagtagctgggattataggcatgtgccaccccaccaagttattttttttttaacaacttttttttttaagagatggcgtcttgctttgttgcccaggctgttctccaactcctggcttcaagtgatctgcccacctcagcctcccaaagtgctaggattacaagcatgagccaccgcacccagctgctttttttaatgaggtcactcctcatgatttcataaagagctttcaaagcatggacattgtacagttgcttgacttgtgtagtattgatgggcattttccctcaatcttctgccattataaacaaggccgggcagagtggctcatgcctgtaatcccagcactttgtgaggcgaaggcgggcagatcacctgaggtcaggagtttgagaccagtctggccaacatagtgaaaccccgtctctactaaaagtctaaaaattagctgggcgtggtggcaggtgcctgtaatcccagctactcaggaggctgaggcaggagaatctctgggacctgggaggcggaggttgtggtgagctgagattgcgccactgcacactccagcctgagcgataagagcaaggctccgtctcaaaaaaaaaaaaaaaaaaaaaaaacattacaggcatgagccattgtgcccggctggtcagatgtttcttaaattttagtcattccagtagatgtgagtgatatctcattatggttttaatttgcttttccttagtgactaatggaagtttgaacatctttcatatacttattggccatttagaaatcctctttgtgaagaacctattcaagtcttctgcctattttatattggatgatctttttctttctttcttttttttttttttttttgagacagggtcttaccctgttgtccaggctgagcactgtggtgctatcatagctcactgcagcctcaacctcctgggctcaagacatcctcccactgcagcctgggactgtaggcacgtgccaccacgtccagctaatttttgtatgttttatagagttgggggtctcactatattgttcagactggtcttgaactcctttatgcaagccatcatcccacctcagcctcccaaagtgttgggattacaggcatgagccatcgtgcccggcggtctttttctttctgattctctgctcactcttgtattcactcatctgttcacctacattctctctctctcattggctacttcactcactccatcatctacacctgcttccttttataccacacacacttcttgagtaccaatcacagccacactgttttgtgtcaggctttacacatattaccttgttttagagaaataaaccactagaatccaaacagttaccccatttcacggatgaggaagcagacgcatgggaaggttatgaagtctgtcttcttgcagggacccccagctctcacaagtgtgtgttcctttcactgcctttattcttcatatctctctcttcttttcttcagggaaagagtatgccaagggagacagccgatacatcctgtaagtgtttgcctctgtcaatggagactggcattggttttcggggggtggtgagttggggagcactaatgggctaacctgtaggaagagcacaccgataccagtgtcccctcatgctttctcctgcaggggtgacaacttcacagtgtgcatggaaaccatcacagcttgcctgtggggaccactcagcctgtgggtggtgatcgcctttctccgccagcatcccctccgcttcattctacagcttgtggtctctgtgggtaaggaaagggcactagaggggcactgggcactagaggggttgatgggggatccacagacacagatgtatccctgtgggtgggatctctcaacggtgcccttccaggggtaagtcagactgaatgacaaaccccctgaggctctggaaaggtcatgcccttctctgagcctgcactctcaggtggggagggttcatttttcttcctcctcctccttctccatcacaaagtctcctgtgaaggttacatgaggtggcccagggtggcaagaagcccctggaacctccaggatcagggctctgagatcccttcatgtaagattctgtcatattttttttaaaacagggtctggctctgtcacccaggccagagtgctatggtgtgatctcggctcactgcaacctccacctcccagactcaagcgatcttcctgcctcagtctcctgagtagctgggactacaggcatgtgccaccgtgcctggctaacttttgtatttttagtagagatggggtttcgccatgttgcccaggctggtctcaagctcctgagctcaaacagtcctcctggcttggcctcccgaagtactgggattacaggtgtgagccactgtgcccggcctcagtcatcttgtgttattaaattgttagctttctttagttctagcgatatgagttatctttagtcccagaatcctaagctgtcttggatttgaggattttgaacttccttaaatctgaaggtgtgagctctcctgagttctgaaattctcagctctctggtgtctggaatctcacttttctgatttctcagattttcagctctgtgatttcagaatacttagctctgagaccttgaatgatgacttggaaagtgctttggaatagagaattggcgaaagtgtccccttcctcactggggcttctccttcccctcctgccacccacaggccagatctatggggatgtgctctacttcctgacagagcaccgcgacggattccagcacggagagctgggccaccctctctacttctggttttactttgtcttcatgaatgccctgtggctggtgctgcctggagtccttgtgcttgatgctgtgaagcacctcactcatgcccagagcacgctggatgccaaggccacaaaagccaagagcaagaagaactgaggagtggtggaccaggctcgaacactggccgaggaggagctctctgcctgccagaagagtctagtcctgctcccacagtttggagggacaaagctaattgatctgtcacactcaggctcatgggcaggcacaagaaggggaataaaggggctgtgtgaaggcactgctgggagccattagaacacagatacaagagaagccaggaggtctatgatggtgacgatttttaaaatcaggaaataaaagatcttgactctaacactgagagatccttaattactaaccccagagatgcgctatgactgaccccacagatcccaccatcattcacttattccagacccccatcagcatctaaagacctcccacctctgacctcacaaacccctatcactgaccccccgccagaccccataactcactacacagaccctatcactggccccacagtcccctggtcttaactcgagctgccataacagaatgccacagactaggcttaaaccaccgaagttcattttctcacagttctggagtccaagatcaaggtgtcagcaggtttgacttctcctgaggcccctgtccgtagcttgcaggtggccaccttctcagtgtcctcacatggtctctatgaactagcgtccctgtccctggtgtctctctgtgtgtccaaatttcctttttttttttttttttttgagacagggcctcgctctgtgtcaggctggagtgcagtggtatgatcatggttcactgcagcctctacctccctggctccagcgatcctcctgcctcagcctcctaagtagctgggactacaggtgtgcactaccacacatggctatatttatttttttttatagcaatggactctcactatgttgcccaggctggtctcaaacacctgggctcaagtgatcctcccacctcaaccttccaagtaactgggacaacaggcacatgccattatacctaatttttgttttgttttttttttttgagacggagtttcactcttgttgcccaggctggagtgcaatggcacgatcttggctcaccacaacctctgcctcctgggttaaagcaattctcctgcctcagcctcccgggtaggtgggatcacaggcatgtgccaccatgctcagctaattttgtatttttagtagagacggggtttctccatgttggtcaagctggtcgcgaactcccgacctcaggtgatctacccgcctctgcctcccaaagtgccaggattacaggtgtgaaccaccatgtccggcaatattttttcaattttttgtagagatggggtctcactatgttgcccaagctgatctcaaactcctaggctcaagtggtcctcccacctcagcctcccaagtagctgagactacaggtgtgaactaccatgcctagcccaaatttccttttatgaggacaccatttgaccagcctgggcaacatggtgaaaccccatctctacaaaaaaaattttgaaaattagctgggcatcatgaggccacggtgggaggatcatctgagctagggaggtgtaggctgcagtgagccatgatcacggtgagagcctgtcttaaaaaaaaaaaggaggtggggggtgggcaccagtcaggcacagtggctcatgcctataatcccaggctgacacaagtggatcacctgaggtcaggagtttgagaccagcctggccaacatggtaaaactccatctctactaaaaatacaaaaattagccatgcatggtggcacatgcctgtaatcccagctacttgggaggctgaggcaggagaatcacttgaacctgggaagttgaggtggcagtgagccaacatcatggcactactgcactccagtctgggcaacagagtgagactctgtcccaaaaaaaaaagtggggggcaccatttgtattggattaggcccactctatgagtcccattttaacttaaccacccttttaaagtccctatctccaaatatagtcacattctgtggtattgggggttagggctttaacatatgaatttggggaggacacagttcagtctataacattctgctctctctggcctcccagaattcatgtccttgcatgcaaaataccttcacccccatcccagcagcccaaaactctcttttgtttttttggagacagggtcttgctctgtggcccaggctggagtgcaacggcacgatctcaggtcactgcaaccacagggtttcactatgttggcctggctggtcttgaactcctggcctcagatgatccacccacctcagcctcccaaagtgttgggattataggcataattcactgtgccataagccactctgaaagctcttaatcaagtctagcattaactttcagtcccaagtcttacctaaatatcatccaaatcaagtgtaaatgagactggaggtatgattcatcctgatgcaaaaattcttctctagctgtgaacccgtgaaaccagataaatcatctgcttccaaaattcagtggtaggacaagcataagctagatagatatttccattccaaaaaggagaaatcacaaagaagaaagggatcacagtccaggcgtggtgactcacgcatgtaatcccagcattttgggaggctgagatgggagggtcacttgagcccaggtatttgagaccaccctgggctacatggtgaaaccccgcctctacaaaaaactaaaaaattagccaggtatggtggtacatgcctatagtcccagctcctcaggaggctgaggtgggaggattgattaagcccaggaggtcgaggctgcagtgagccctcttctcaccagtgcaccccagactgggcgacagagcaagaccctgtctcaggagaaaaaacagggatcacaggttccgaataagtttgaaaccaaatagggcaaattctattagatttttaaggcttgagaataatcctgtttggctctatgttctgtcctctgggcccaccagattgggggccccactttcctggttcactggagaggcggtgtctctccctgagccctgggtggcagcctggcccactgaaacagaggaggcctctttgccctctggaactgaggaggagacagccccacctttgggatcattctccctttttcttgaagtataatgcatgttcacagccagaaagctctgttgtcgtgtcctgttgaatcccagaagtcctacagtcttctttcattttgtcccatctctgtcctctttagtcccagctggccgtgtttctgctggtattacccatctgtattcctggcttctgccaagatggctgattaggtcagtgagtcacacccatgatctctttgtggcatgattgtttagccacaccctttgtcttctcaccagaacacattctcagcttttgcagtgttggataggctgagaacttttttatcttcacattcgagttcccttctgcctgacaatttcttttgcaatttctctctttcctcttgcattctactagaagcagcaaggagaaaaaggccacataatatgctgcttagaaatctccttagctaaatctcccaagttcgcctctcacaagttctaccttccacaaaacactagaatacaattaaccaagttctttgccttccctccattttccaataacatattcctcatttccttctgaggcctcaccagaagcactttcaacatccatatttctaccagtagccttcaagataattgtcttagtcatttggactgctctgacaaaatactataaactgggtagcttataggcaactgaaatttatttctcacagttctggggtctgggaagtccaaaatcaaggtgttggcaaattcagtgtctagtgagggcctgcttcctcacagatggctccttccctctgtacccttatatggtgggagggtagaactccggtcccttcatcccttataagggaatgacctaatcacctcccaaaggccccacctcctaatatcattacactggggattaggtttcaacataggaattggaggttggggggacacaaatattaagatcatagcagcaacataggctttttctaacatgcacctcaaaactctttcagcctctacccattacccagttccaaagctacttccatgttttaggtatttattatggcagcaccccacttcccaggaccaaaatctgtgtcagttttctaaaactgccataacaaaatgccacatacctggtggcttaaacaacagaaatttatttcctcagagttctggaggcggaaaatccaagttcaaggtgtcaaccagtttagtgtcccctgaggcttgtagatggtcaccttctcgccatgtcctcacacagtcttccctctgcctgcgcatgtcggtgtcctaatctcttcttatagggacaccagccagagtggattgggacccgccttcaccaacttcattttaacttaatcacctcttgaaaggccctattttcaaatacagtcacattctgaagtattgggggttagggcttcagcatgaattttggggagataccattcagtcagtaataccgctctgtgctcaccccactcactccctaatacttagcctcacagatcttccatcattcaccccacaaacccccatcacatgccctgattactcagcccacagattcccctgcattgctgccacatggacccccccaacacccaccctatagacttcccatcacaaaccctaaagatcccccatcactcaccccacaggccctatcgtgaaccctacatattcacgtcattcacctcacagagccacattactcatccaacagactccacccctggatcattcagcttattggcccctaatcacttcactcactctacagactcactcatcactgactctacagagctctaatcactcatcccattgacaccccattactaaccccacaggtgcctcccactcatctcacaggccctccatctctcacaccacaaagccctctcaccttatgagctagcacatcagcacccctacagacccccagtcattcccccaccccacagatgcccccgtcaccccatagatcctcatcagccatctacagatcccccattcctcaaagtcctccttcactccccctacagacttgccccacagcccccatcattaatcccacagaatcctgccactcgccactcaataccccattcactccacaggctcctcatgaccctacagaccccgtcactaccccacagatccctattactcagtttattatcccctgatcataccttccagagaggccccatcgctaaccccacagaccctaatcctcccctgtgttagtcggctctggcttccgtaacaaaatgccacagaccaggtggcttaaacaacaaacagtttctcacacttcgggaggttggacagtccaagtgcaaggtgccatcagggttggtgtctggtggggtttctctccttggcttgcagatggctaccttcttgctgtgtcctcacgtggccctttctctgtgcactcatgcccagtgtccctcttcttataaggataccagttctactgaattagggccccacccttataatctcatttaaccttaattacctccttaaaggctctatttcagatatagtgacattatgttgaaatattgggggctggttcccctgatattagggcttcaacatatgaatttggggaggaggacatcattcagttcatgacactccccatcactcaccccacagatgccacagctctcacctcacagagcccccaacactcctaccacatatattccatcactcagcctcttggcttctgataagccaccccacagatcccccatcactcttcccacataccccatcaactcctaagatacccatcactctccctaccaacacacattcattcgtttcacagattgcccattattgaccccacagaaaccccgtaactcaccacacagacctcaaccccatcactcacccccacaggcccctatcacccccaaaatcttcactctgaagatcccataactcaccccagaagcccctcatcagtcaccctaacaacccctatcactgacaccacagacccaccactcatcctacagatgcccctttactaaccctataagcatcccataactcaccttgcagaagccatcactcaacccacagagtccatctctcatcccacagaccccttatcactcacaccaccatcccatctctcaactcacggtcctccacaatccaccatatacaccccatcactcacccacagatgccatcattcacccctcagacccccatgacttacctcatagtgcacctatcatgtacccacagactcccatccaccccagggatcctccgtcactctccacagacctgctattattcacccaacagacacccctcacttactctacagacccccatcactcatcctgccgtctatcattaccttatagaccctccatcataaaacaactgggtacttgagaagttttgaagagatggaaaagaataaataataaaaccacagatacctgtagactggcttcaagtgacctctgtaaggccgggcacagtggctcactcctgtaatcccaacactttgggaggctgaggcgggcagatcacctgagggttgggagttcaagaccagcctggccaacatggtgaaaccccttctgcactaaaaatacaaaaaaattagccaggtgtggtgccaggcacctgtaatcccagctacttgggaggctggggcaggagaatcacttgaacccgggaggcagaggttgcagtgagctgagactgcaccattgcactcaagcctgggcaacaagaacaaaactccgtctcaaaaaaagaaatatcaagtgacctgtggacttcagttcaaatcctggctctgcttaggcctacagtatatagctttggagaaatgcctcactgttaaggtcaaagccctgcatgatctcactctattctcacctcgtctgctgtcactcacctatcattcactctacttaaaggcatgctgacttccttgcttttcctcaaacacaacaggcatagccccaagttccatccattgcactgcctactctctgtgacactaccccctttgaccttgagcttgtttctccctggctttcagtactctaatctgtagaatgcttagagtaataacacctacctgctatggttcgaatgtttctcccctccaaaactcatgttgaaactaaatctcttttttaacagaattaaggaggtgggaaatctgactacggtatttgagagatgggaccttgagcggtaattaggattagattagatgaggtcataagggtggggcattagtggttttctaagaggagaaacagatctgagctagcaaggtcagcacccttaccatgtgatgccctgctctgcctcgccactccacagagaggccccaccagcagaaggccctcaccagatgtgactccttgaccatggacttcccagcctccagaactgtaagaaataaatttcttttctttcttttttttttttggtggggggggggtgttgttgttgttgttgtttttagagacagggtctcactctgtcacccagactagagtgtagtggcatgatcacagctcactgcagcctcaaacttctgagcataagcaatcctcctgcctcagcctcctaagtagctagtactacaggcatactgccatgctcagctaatttttaaatttttttgtagagacagggtcttgctatgttgctgaggctgttttgaactggcctcaaagcaatcctcccacctcagcctctcaaatttctttataaattacccagtcttgggtatttgattatagcaacagaaaaatggactaagatactacctcatagggtttttatgcagattataagaattaatttatgtagactgcctagcatatactttatatttgttgaatggaagaatgaataaacaaaaaagaaagttctccccaggactatggcaaggacctcctttttgatctccttgcttccagtatctttccatccaaagctctccccaggaccaagacagaggcatctgaccacatcatacccctgtctaaacctttgccccagtgtccttaggatcgattccaaactccaggctaatggtttgcacatcccaccctatgataaatgaaaagcaggctcttactccttgtttccatcagaaaatccagcagtgctataagtgattttgactctaaacacatggggcaagagagacatgccaataatccttttctggctttcagagaaaatccccattatttataccttctaaaaatagagatatctatttaatgttaataccaaggcaacatgttgtcttaaaagacaccaaaatagaattgcagacttacctaaaaagttaaccttgagggttgcgtccatatgacacggacacaatagttggagtgctagtatcttacaagactcctttgttggaaataacatttgtttttgttttttgtttactttttttttttgagacggagtctcgctctgttgcccaggttggagtgcaggctggagtgcagtggcggctcactgcaagctccgcctcccaggttcacaccattctcctgcctcagcctcccgagtagctgggactacaggcgcccgccaccacgcctggctaattattttgtatttttggtagagacggggtttcaccgtgttagccaggatggtctccatctcctgacctcgtaatccgcccgcctcggcctcctaaagtgctgggattacaggcgtgagccactgtgcccggccagaaataacatttgtaagtgcagcctgtattttgtccaaaccgcacggatgttgtgcaattaagtgggaagactgcctttttgcattttgccacatataaagtttctcagaagagtctaagatatattcaataattcagccaatatctagtagacatacaccatttaagaacaggaccaaccttaacatgttatgaagattaggtaagacaaaagcaaagttttgtgggcttttttttttttttaatcaggttctcactctgtcacccaggctggagtgtagtggcgtgatcacaactccattgcagcctggacctcccaggctcaagtaatcctcccacctcagcctcccgaatagctaggagcacaggtgcgcaccatcagacccagctaattttttttttttaattttgtagggacagggtcttcctatgttgcccaggctggtctcaaactccccggctcaagcgatcttcccacttcggcctcccaaagtgctgggattacaagtgtgagccactgtgcctgactcagtttattttttaaaatttttcttcatttattcttggcttcttccattcattgttttgatcactaactatgtgctcagcacattgctgagccttttgcatgctctgctgggcattccccatttgctcttccggatccattatccaccctgctctgggaccccaaaaagctgatcttttatagatggtatcatttgggccccattgattggttcgtagttgagcctggccacttctctttcaactggtccctggcagtcagtaccaacattttagtcaggtttcaaagaaatctctagaccaagctggacagagggcttttccagtgattcagtgattccccaagatctgagaatgtgaaacttggaaaagggacacaaagaccggggatcctttgagctggttcaataatggcagagctttagagatatgctgctgagctccctgggtctgtctcgctttctgccttctgaaggcttgattgttaacttcttcctgggtttcaattagaagcattagtgtccttcctggagttgaattacctggaaatttgcctcctagatgtgtaaacttgggaaagtatgatctcgtcaagtttcagacaaaggcaaactaaaaagctagaactccagagagcataatagtgttttttgggggcaaattatttaatgaagtataacattcatacaggaagtacaaaaatcatcagtgtacaaaatctccatgaattttcacaatgtgtaaaccattttcctgttttatctgaccttactaagtcagggtataaattattaattttttttgaaacagggccttgctctgtggtgcaggttagggcagtggtgtgatcaccgctcactgcagccttgacttcctgggctcagccatcctgccgcttcagcctcccgagtagctgggactgcaggtgtgcgccaccacgtccagctaattgtttaattttttgttagagacggggtctcgctgtgttgcccaggctggtctagaactcctgggctcaagcgatcagcccgcctcggcctcccaaagtgctgagattataaggcgtgagccactgcaccctgctgagtatatttttaaaaacactttacccgagggctgtggctcacacctgtaatcccaacactttgagaggccgagacgggtggatcacttgaggtcaggagttcgagactagcctgggcaacacagctaaaccctgtttatacaagatatacaaaaattggctgggcgtggtagcacgcgcctgtagtcccagctcttgggaggctgaggcaggaggatcgcttgatcatagctcactttgaggctacagtgagctgtgatcgcgccattgcactccaacctggatgacagagcgagaccctgcctaaaaaaataaaaaaaaaaaggatttttttctgttcagtggattcatttgaagcgagggccactggtatttgaaatagatgacatcatctgccagcagaggcgtgaggcaacttgaggcggggtgtgggcctgacgtcatcacgcagcctcttcctttccccgcccccttctcttggcgaacgaggcgtcagtttaacacctccgtgaatccggaagtatgctgtcaaaacaaccaaaccacggggctgggggaggcggggcctcagtaggcgtctgcacgctagctgaaatagagcaaaatgcccgacttttgggggcggggctcctggcaacagcactctaggcgcaggcgcagaggcgacctccaggcagggccaggtgggagggacggtggggggtagggtcgcgcggcgccctctgcgcctgcgccccggcacgaggtggggcggcgggcgtcagtacagtagagtgtgcgccggggtggggggcaacggtcagccgtcaccctgagacgggcggcggcgggatggcaacagcctccggggcctcggacttgtctggctccggagcgcccccgcccggtgtgggagctcaggcggcggcggccgctgaggaggaggagcgagaggtggtgcgggtccgagtcaaggtgaggctggcggtgagtcggcccagccgccgaggcatcccaggggagggggaggcggtggctgtcataggatggagggcgggacctgagatttcggacataacctgagcggcgaagcttgagggccaagtgatgatggcgaggggtagggagggcctgagagcctgagagcgttagcgacgtaccttggggcgtgggactgaaaatagagggacgaggcgggggtctatgggatgaatgggtggagcttatagacaaaggggaggggctatggggctggaggaggggccgcagtagttgagggtggggctctgaggaatgagaaggtgctggctctggagtcagtcaacccatgtgttgagagtgcacttatgtgcaagttcccactttgatgagctgacaggctcgtgggtggagacaactaaagaaatgagatgcttcggacactaaaataatgaaaaaggttatgaaatagggagtcacgttagccaaggttgtacagggaaatccccagaggaggtattgaaggagcagagacccgaataaaaggagtcagccatgtgcatattagaagggaagagtattctaggcagaaggaatagcaagggcaaagactagaggatgggaatgagcctggcatgttcccgtaggttcctgattgctggagtggagagaatgaggggaagagtggtaggaggtgaatcagagcgctaagacagagacagatcgccaagggcctttggtgtgtatgctgaggaagaacgctgttgccatagttccagtaaacaatgatggtggctccgaccaaccagtggcactggcagtgataagagggtccacacatcacttcagtgtaatagagctctaaggtagaagtttgacattcagaaaaaagatgatgcctgagctgggcgtgaaccacgtgaagaaagtgggagggatgttccagacaggggatcagcacaatcaatggcctggagtcaggatggtttcaaggtaacttctaacagtttggtactactagagtgtaaagttcaaaaaacctggtgagaggctggctggggccccataggcccgcttgctgggactctagggttgccattgaagagattgaagcaggggagtgttgtaggtagatgtgttagattggttacagcaccatagaggactgatttaacaggagccagactggacacggtgattctggcaaccatagttgaagggatatagaagaaggattgggggcctgaactcttgcagtagcctcctcctcactggaccctgtggtccagaacacctgccttgatctggcccctggcacctctctgactttgccttctaccactctgcacctcactcttcagcatggtgatggggcccctggtggcctaccccatgtcttctctccccagaaatgtgagagcttcttgccgccagagttccgctcttttgctgtagatccccagatcacctcgctcgacgtgttgcagcacatcctcatccgagcctttgatttgagtgggtgagtgggaagatgctggggactggccagtgggccaccgacctctacagtggctatctggcctttgtttggtagggtttttgtttattttactactacaaataatcccacagtgaacagccacgtatgcatgtcttggagcacagtagtctacttttgtctgtggttttgctttctgcagtttcagttacccatggtcaacctcagtctgcaaatattacatacaataagatattttgagagagagagagagaccacattcatattacttttattacagtttacagacagtccccaacttacaataactggacttaggatttttcaactttacaatggtgcaaaagcgatacgcatttggtagaaactgtactgcaagtgcccagcgattctgcttttcactttcagtacagtgttcaataaattacatgaaatattcaacactgttgtaaaacagactctgtgttagatgattttcccaactgtaggctaatgtgagcgttctgagcacgtttaaggtaggctaggctaacctgtgatgtttggtaggataaatgtgttaaatgcattttcctttttatttctttttttttttttttttgagatggagtctaactgtcacccaggctgcagtgcagtgacatctcccaggttcaagtgattctcctgtcacagcctcccaagtagctgggactacaggcatgcaccactatgcccggataattttttttttttttttttttgagacggagttttgctcttgtcccccgggctgcagtgcagtggcgcagtctcagctcactgcaacctccgcttcccgggttcaagtgattctcctgcctcagcctcccaagtagctgggattacaggcacgcaccaccacgcctgctaatttttgtatttttattagagacaaggtttcaccatgttggtcaggctagtctcgaacacctgacctcaagttacctgtccacctcggcctcccaaagtgctaggattacaggtgtaagcccccgcacccagtcccagatagttttttgatcttctcttttttttttttttggagacagagtctcactctgtcacttaggttggagtgcagtggtccgatgttggctcattgcagcctttgcctcccgggttcaagtgattctcatgcctcagcctccagagtagctgggattacaggtgtgcaccaccacactcagctaattttcatgaggttggtcaggctggtctcaaactcctgatctcaagtgatccgcccacctcggcctcccaaagtgttaggattacaggcacgtgagcctccgcacccggccaattttttgtatctttagtagagacagggtttcgccatgttgcccagggcagtctcaaactcctgagctcaagcaatccgcccgcctcagcctctcaaagtgctgggattacaggtgagccactgcgcccagccaaatgcattgtcaacttacagtatttccaacttacgatgagtttattggtacataaccctgtcataagtcaagaagcatctgtattgtcataattgttctattattgttaatctcttactgtgcctaatttatcaattaaaccttatcataggtatgtatgtatatgaaaaaaaacatagtatatatagggcttggtactatctgcagtttcaggcatccactcgggggggtcttggaatgtatcccctgtagataaagagggactactgtatttggaaacatctagtcataggataaattcctagcagtggtattgccaggtaaaagggtatttgctttaaaaaaaattttttttttgagacagtctcattctgtcgtccaggctggagtgcagtggtgtgatctcgtctcattgcaacctccacctcctgagttcaagcaattctcctgcctcggcctcctgagtagctggtactacaggcgtgcgccaccatgcccggct[135 bp omitted]ctttttgaactattaatgggtgtttccaaaatgctctccagacaggttttatcaatttatgatctcagccgggcgctgtggctcatgcctgtaatcccagcactttgggaggctgaggcaggtggatcacgaggtcaggagatcaagaccatcctggctaacacggtgaaactccgtctctactaaaaatacaaaaaattctccaggcgtggtggtgggcgcctgtagtcccagctacttgggaggctgaggcaggagaatggcatgggcccgggaggcggagcttgcagcgagccgagatcgcaccattgcactccagactgggcgacagagtgagactccgtctcaaaaaaaaaaaaaaacgaatttatgatctcatcagcagcacataaatgcctgtttccctcacaccctcgcaaacattggttactgtaaaactgcaaaatttgccaatctgatagctgaaaagtggtgtctcttgggggcagatgtgatagtcattttgttgtgattttggaggaatacatacacatggtaagaaattcaaacagtacacaattgttgggtatttaggatgtttccatggttatgatgagcatcacgcaacaaacttctttacatagttgcacaagtatagctgaaaaattcttagttgttattagactttcttacataaacatttttgttgtgaaaaataacaaacacagattgctttttttttatgtagtaagaaggctgctttcttcccacttctgtcccacatctaccccagaggggaccaacttttttttttttttttgagatggagtcttgctctgtcacccaggttggagtgcaatgccacaatcttggctcactgcaacctccacctcccaggttcaagcgattctcctgcctcagcctcctgagtagctgggattacaggcacctgccaccacacccagctaattttttttgtatttttagtacagaaggggtttcaccatgttgaccaggctagtctcaaactcctgacctcaggtgatccacccacctcggcctcccaaagtgcggagattataggcgtgagccactgcacccggccaacattttaccagtttccaatgtgacctccagatacaagcaggtgtgtacctgcttgtatgtgtttgtgtaacaaagtgggtataaatgacctgatctcaggctgcccataatccttggcacagtaccttgcacatagtaggaagttgttttcaacgccttctatattaccctccttgttttggaaactgtccctgaggcctccagggcaccaggggccctgagagctccctcgtatcccctgtccaggaagaagaactttggcatcagctacctgggccgggaccggctaggacaggaagtttacctctcacttctatctgactgggacctcagcacagcctttgccactgcctccaaaccttacctgcaattgcgtgtagatattcggccctcggaggacagtgagtactcagtgcccccaggagcactgctctggaacccctttaccccatagggtgatgctacccctcacagtacactccctcatggtgggatgggtagcaaggtatcctagctatagatcctggctcagccactaggccacaatttcttcacttgtaaagagataattgtatcttagaaccattgtgaggccttgtatcttagaaccattgtgaggggaaattcatataaaatgcctggaacagtgcatgactgcataatgaaggctcagaaagtgttatctctaataatgataattatattgtattatactattataacatataaccgagtaatgtatgtaataattagatataatgcagatttataatatagtataacggtatagctttagcattatgtatttcagttataatacctaaatataacaatgcgtattataataatgctagttgtgtttattcattcagtcattctgcacccatattcatttgtttgtattcttgctcactcattcatttgttcccttgacctctcagccactttttctcttctcatctttgttcttccactcttgcctattctggtccctgcgagcacacagataaattaggacgtggtctcaaaatttgattacagaccatacattagataattgtatcagtattaaatttcctgggtgtgtgtcttagtcgttttgtgctactataacagaataccacagactgaggaatttgtaaagaagagaaatttatttctcacagttttggagactgggaagtccaagatcaaggtgctggcaggttgtgtgtctagtgagggctttcttgctgcatcctcacatgacagaagagcagaagagagtgaacccacaccctcaacctctttataagagcccaaatccgctgggcacggtggctcatgcctgtagtcccagcactttgggaggctgaggcaggcggatcacctgaagtcaggagttcgagaccatcctggccaacatggtgaaaccctgtctctactaaaaaaaatacaaaaattagccgggtgtagtggcacatgcctataatcccagctactcgggaggctgaggcatgagaatcgcttgaacccgaaaagcagaggttgcagtgagccaagatcttgccactgcactccagcctgggtgacagagcgagacttcatctcaaaaaaaaaaaaaaaaagaggctgagcacggtggctcacgcctgtaatcccagcagtttaggaggccgaggcgggcagatcacaaggtcaggagatcgagaccaccctggctaacacggtgaaaccctgtctttactaaaaatacaaaaaaatagccgggcgtggtggcgggtgcctgtagtcccagctactcgggaggctgaggcaggagaatggcatgaacccgggaggcggagcttgcagtgagccaagatcgcaccactgcactccagcctgggcaacagagcaagactccatctcaaaaaataaataaaataaaaaataaaaaaagagccctaatcccatctgtgagagctctaccctcaggacttaatcacctcttaaaggcccccacctcttaatatgatcacattggtaattaaattgcaacacatgaatttggaaggacacattcaaaccatagcagtgtggtagtggtatcatatctattgaaggaaaatatccttgttcttgggaaagacacagttaagtatgaaggggtaaaatgtcatgatgtctgcaaataagttggcaaaaataatgtgtttatatacagagagagtgagataaagcaaatgtggcccaaaaaaatgttaatagaggatctagatgaagtatgtatgggtgttcagtgtattcttttaactttattgtaggttcaaaattgttttaaatagttgtggagtggaagatgtggttcccagcctcaggaaactcatgtgcccatttgggatgagtcgagcactttattgatgtcataataacatataactagctaatgtgtagtgaacacttagggccattctgtgcacataatattttttcactgaattgtcaaaataatcctatagagtagggacaatcattttccccatattatagatgaggaaactgaggctcagagaggtgacaggactcgtcccagttatacagacagtaagttgaagagcaagatttgaactcaggcagtggctgaactggctccagagtccttgttcttaaccatttaactctacaacattttggacttgttaaaattggcagctttgcaaaagagagacagaggagagagagaaacaagagtcagagggaaagatagtgacagagatgggcaggaagccaaataggaaaagccaggtagccagacacacaggaacctctgccactgagtagccatatgtgcttatgtcagtcacttaattccctgggccttgttttcctcacctgttaaagagacacagtagcactatttcaggaaaaaaatcaaatctgcatggctacgaaacatgtggagaaaaccccaagtgcatgagaactgggacgaatgccagtaaagcagagagacagacagaaagacacccagt[153 bp omitted]ctctactaaaaatacagaaattagccgggcgtggtggtaggcgcctgtaatcccagctactcgggagactgaggcaggagaattgcttgagcctgggaggcggaggttgcaatgatccgagctcgtgccaccgcactccagcctgagtgacagaactagactccatctcaaaaaaaaaaaaaaaaaagccctctgtcttatttaccaaattcctgcacaacatcggtctgtttctgaattcctgattctcttacgttgatctatttattaaattataagccaattctatgttgttttaatcattgtagtagtttgttttctgtttgtttgtttggttttgagggttttttttttgttttttttttgagacagggtctcactctgtcatccttgctggagtgcagtggcccaatctcagctcactgcagcctccacctcccaggctcaagcaattgtcccacgtcagcctcctgagtagctgggcctataggcacatgcccccatgcccagctaatttttgtattttttgtagagacagggtttcgccgtgttgcccaggctggtcttgaactcctggactcaagcagtctgcccgcctcagcctcccaaagtgctgggattacaagcaagagccaccgcacccagccttaatcattatagttttatgatatgttttcatgttttcctttttaaaaaattttcttgaatattcttgttcacttactgttctttttatttaataaatcagcttattattccattaaaatcctgacgggaatttgattggagtcatatttttaagagaaactaatctttcattacccagtaaatacattcttattaaaaataaaagcattttaaataatgctgaagtctcctgggaacgctatgcctaatctcaatcccctaccctaccctttttgccccgagggaatcggtttgatgtgtaactttgcatgtcctttacttatttacactccctacacacacatttatccacatatgtgagtatattcatatttgcgtgtctgtacacataaacggtatgtgtttaacataaggtattctacacattaatatgtaagtgtccaatatatggagctatcattagacatattaatggcattctcatgatcattttcatggctgtgaaagcaacagacatgttgggactgtttggatggcccagtccctctttctgggaaaaagccagtttctgtcacctctacagttgggagattacaaagcctagacctttgaccaatttgtacttttccgatatgaatcttttttctttttgagactctctttgtcaccaaggctggaatgcagtgacgcaaatatggcccactgcagccttgacctcaagctctcctcctgcctcaggctttcaagtagctgggactacaggtgtgcaccaccatgcccagctaatttttgtattttttgtagagacatggttttgccatgttggccaggctggtctcgaacttctgacctcaagtgatccacccacctcggcctctcaaagtgtttggattacaggcgggagccaccgtgcccagcccccaacctcctttctatcataggtactgcaaatatttttcccagttgatcttttgttttttggctttgcttacgggatggatctgttttgtcctatcaaaattaaacatttgattgcacgcctacacagatatctatctttttctttatgatttctgagtttctcctttttattgcaggtggagggacagagtttcactctcattgcccaggctggagtgcgatggcgcgatctcggctcactgcaacctccgcctcctgggttcaagtgattctcctgcctcagcctcccaagtagctgggattacaggcatgtgccactacacctggctacttttgtatttttagtagagatggagtttcaccatgttggtcaggctggtatcgaattcctgatctcaagtgatccacctgcctgggcctcccaaagtggtgggattacaggcatgagccactgtgcctggctgagtttctcctattactttggaacatgttccccatccataagcttatacaaatattctatattttcttctactatgcttattgttttcttttttacatataaatcttttctctgtcagcattgtgataagcagacctagctttaaaaaaatcaagatagtcaattatgccagcatcattttttttaatttaatttttttttttgagacgaagttttactcttatcgcccaggcaggagtgcagttgcacaatctcagctcactgcagccgccgtctcctgggttcaagcaattctcctgactcagcctcccaaatagctgggattacaggtgcccgccaccatgcctagctaatttttgtatttttagtagagatgaggttttgccatgttggccaggttggtgtcgaacttatgacctcaggtgatccacccacttcagcctcccaaagtgctgagattacaggcatgagccactgcgcccggcctgccagcatcatttattaaataatcaccttttctgcagtgattcgaaatgccacgtttgtcacatattcagtttccatatatacaagcttggatttatttctgggctttctattgcattctaccaatgggctctatttgtctactgctgtgctaacaccatgtt[139 bp omitted]cctcagcctccctagtagctgggactacaggcgataagcttttgccatcctcccactgttctttgtcttaactttttttttttttttggagatggagtcttgctctgtcgcccaggctggagtgcagtggcacaatcttggctcactgcaagctccacctcctgggttcacgccattctcctgcctcagtctcccaagtagctgggaccacaggcgctcgccaccacgcccggctaatgttttgtatttttagtagaggcagggtttcaccgtgttagctaggatgatctcgatctcctgacctcgtgatccacccacctcggcctcccaaagtgctgagattacaggcatgagccaccgcgcccagcctgtcttagctattcttaaatgtgaattcttctatagaaaccttaagataattttatccggttccaggaaaaacccccattcaatttctgactggcattgcactgagtttatatattaatttagggtttgggaagtttgacaattttatgataaggaaatgcgcgtatcatgaatattatgtaataccacaagcagggtctgggccagcagccaagcagcccacaatgaaacacttggatgtttcttcagggaaatgtgtgcatattcacactacgtgggttatataaagactatatatagtctcctgtcagttcagatcaggttttgctactaggtgagtttgtgtttgtagacattctttgcctgttttttgtttgtttgtttgtttgtttttttgagacactctgttgccaggctggagtgcagtggcacaattccggctcactgcaacctctgcctcccaggttcaagcgattctcctgcctc[134 bp omitted]cttctcaaagtgctgggattacaggtgtgagccactgcgcccggccttttttttcctttttttgagagggagtctcacattgttgcccaggctggagtgcagtggcgcgatctcagctcactgtaacccctgcctcccaggttcaagcgattctccttacctcagcctcccaagcagctgggattacaggcacctgccaccacacctggctaatttttttttgtattttttagtagagatggggtttcaccatgttggccaggctggtctcaaccttgtgatccgcccacctcagcctcccaaagtgctgggattacagacgtgagccaccgcgcctggcctctgcctgttttattagtgggattgagggggtggtttttttaatcagtataaaatgtctctttgtgttaaatgcttttggccttgagtgatgctttttctgacattctcatggctactatttttttctgtttgtgtttaccagatatacctttaggattctttaatttttaacctttttgtgtcacctagttttaggtatgtctctcatacctctcgtaaaaacgtcatagcagaatttatgctttttaaggcaactgacagtgaaatcttttttttttctttttgacacgtagtctcgctctgtcgcccagactggagtgcagtggcacgatctcagctcgctgcaacctctgcatcctgggttcaagcaattctcctccctcagcctcccgagtagctgggattacaggcacacaccatcatgcccggctaatttttttttttttttttttgagatggagtttcgctctgtcgcccagactggagtgcagtggcacaatcttggctcgctgcaacctctgcatcctgggttcaagcaattctccctc[168 bp omitted]cactgcaccccgccccaacagtgaaatctttaggccactttttctcctttaatctctcccactttttctggcctttaaaatggagctttggaacacttgtaattcttattcgttttctggtccctaacccttaacttctagcttttgcttagacaacttttttttttttttgagatggagtcttgctctgttgcccaggctggagtgctatggcacaatctcagcttaccgcaacctcctcttcccaggttcaagcaattctcctgcctcagcctcttgagtagctggggtaacagaagcgcaccaccacacccggctagtttttttatatttggtagagatggggtttcaccatgttggccaggctggtcttgaactcctgacctcaagtgatttgcctgcctcggcttcccaaagtgctgggattacaggcatgagccaccacacccagccaattttttttctttttaaattccgggttatcattctgttttcttactaacacactaagtcacttatgtttcaggaatcctaatgtaacatataatattacaaacccccaatcatgttatcgttgtcattttaactataaatattaaatatgtaatatatataatataatatataatatataaatattaccatttaccttcccctttgtctctccctatcttaagcccttctagtcatgcaggagtcatttgctcagagaacttctttgttctcctccaaaagtgcatgggttagatgtactctaatggccaaaaatgtttttatttggctgaatagatctgtactgtcttggctgggtgtggggcccttggatctcaggtctttcttcttagtgctccataggtgctgtgagctactgtcttattgcctccagggttgtgaagcagaagtctgttgcttgtctgaccttctttccattgtaagcagccgttttttgtctctggaagctgcaagagtttttctttttcttttttttttttttttttttttgaggcaggatctctatttcccaggcgggagtgcagtgacgtgatctcagctcactgcaacctctgcttcccaggttcaagcgatcctcccacccacctcagcctcccgagtggcagggactacaggtgtgcgccaccatgcccagctaatttttatatttttgggtagagacagggttttatcatgttcagcccaggctggttttgaactctcgggctcaagcaatccgcccgccttggcctcccaaagtgctgggattaggctgggcatggtggctcatgcctgtaatcccagcactttgggagaccg[134 bp omitted]gagacaggagaatcgcttgaacccgggaggcggaggttgcagtgagccaagatcacgccactgcgctccagcctgggcaacagagcaagactctgcctcaaaaaaaaaaaattgctgggattacaggcatgagccattgcgcccagt[133 bp omitted]caatgtggcaaaaccctgtctttactaaaaatacaaaaattagcaaaaattagccgggcgtggtggtatgcccctggaatcccagctacttgggaggctgaggcaggagaatggcttgaacccaggaggcggaggttgcagtgagccgagatcataccattgtgctccagtctgggtgacagagcaagactccatctcaaaaaaaaaaaaaaaaaaaggatagggttggtggggggcctgttgtgtgttgttagttaattaatcctatctaagacttggtgagccattccttcatctcagggaaattttctttcatacttgtttaattctgacatctccacctgatcccttttctccccctgcatttcctattatttccatatttggtctcctggacttggcatccaggtctctctactttttcactcaaatcattgaaccttagctccatgccttgcagtggttcttctgttcagactttcagaccattactgatttttcataatgtgaccttcttcattttacctgttaagtgttttaatgctctgattaatgttttagaaagaccattctggcagctgttgggagagattggagaggaatacagaggaagtgaggactggttaggaggcagtttcaggtgagagatatggtggctcagacagggtgagaagatggagatgagagaacaggtaggatggaggaatgctttacatgcagtagccgtaggacttggcggtggtttggacctgggagttaagagagtgggagggggacaaggatgtctctcaggtttctggtctattaaacaactgaacagatagagatgctgtttgttgagatgaggagtagaggaggaggccatgtctagagtggatcttgggctcctctctttggaccccttaggtttgcagtaccccatgagacatccagggaaaagcagtgacatgcaaacatggcctagggtttgttccccccctcagctctatgggaaaattgggctccatgggaatgctgtttagggatggcatttgcttgcaaatgacagtggcttaaacagatagaagttg[137 bp omitted]ggagacgagagattgagaaaagaaataagacacagagacaaagtatagagaaagaacagtgggcccagggtaccggcacactcagcatgcgaggacctgcaccagcgccggtctctgagttccctcagtatttattgatcactatttttactatcttggcaaggggagtgtggcagggcaacagagtgttggtggggagaaggtcagtagggaaacatgtgagcaaaggaatctgtatcatgaataagttcaaggaaaggtactgtgcctggatgtgcatgtaggctagatttatgtttcactttacacaaatatctcagtgtagcaaagagtaacagagcagtattgctgccagcatatctcgcctccagccacggggcaattttctcctatctcagaatagaacgaatggtcggctttacaccgagacattccattcccagggacaagcaggagacagaagccttcctcttatctcaactgcaaagaggactccctctttcactactcctcctcagcatagaccctttatgcgtgtcgggctgggggatgtaaggtctttcctttcccacgaggccatatatcaggctgtctcagtgaggggaaactttggacaatacccaggctttcttgggcagagttccctgtggctttccacagtgcattttgtccctggttaatagagaatggagaatggcgatgacttttaccaagcatactgcctgcaaacatattgttaacaaggcacatcctgcatagccctaaatccattaaaccttgattcaatacagcacgtttctgtgagcacatggttggggctaaagttacatacagattaacagcatctcaaaccagaacaatttttcttagtacagatcaaaatggagtttcttacatcttccttttctgcatagacacagtaacaatctgatctctctttcttttccccacataaggcgggtggatcacctgaggtcaggagttggagaccagcctggcaaaccccatctctactaaaaatacaaaaaattagccaggcgtggtggcaggcacctgtaatcccagctactcgggaggctgtggcaggagaattggttgaacctgggaggcagaggttgcagtgagcgaggatcacaccattgcacgccagtgtgggtgacagaacaagactccgtctcaaaaaaaaaaaaaaaaaaaaaagccagccactggacattgccattgttggcttagtagccctctcgtatcagggctgtaggagaggatctctgaagatcctctcgaacctactctcagatggccactgctgcttcaaccaccacatcttatgtgaggtgggaagaaagaatgcggggcaaaatgaaaaagaaagagaaacggtcaggtgcagtggctcacacctgtaatcccaacactttgggaggccaaggcaggaggatctcttgagcccaggagttcaagaccataggcaatatagtaagatcccatctctaccaaaaaaaaaaaaaatcatccacgcatggtggcacacgcctgtaagccccagctactcaggaggttgaggcaagaggatcgtttgagcccaggagtttgaggctgcagtgagctatgatcgcaccactgcactccagccttgggggacagagcaagactgtctcaaaaaaagaaaaaaaagatgcctgtaatcctagcactttgggaggccaaggcgggctgatcacctgaggtcaggagttcgagaccggcctgggcaacatagcgaaacctcatctctactaaaaatacaaaaattaggccaggtgtggtggctcatgcctgtaatcccagtaccttgggaggccgaggcaggtggatcacctgaggtcgggagttcgagaccagcctgaccaacatggagacaccccgtctctactaaaaatataaaattcaccaggcatggtggtacatgcttgtactcccagctactcgggaggctgaggcaggagaatcacttgaacccaggaggtggatgttgcagtgagccgagatcccgtcattgtactccagcctgggcaacaagagtgaaactccgcctcaaaaaaaaaaaaaaaattagctggacctggtggcaggcacctgtaatcccagctacttgggaggcttaggcaggagaactgcttgaacccaaaaggtggagtttgtagtgagccaagattgcaccactgcactccagcctgggcgacagagtgagactccatctcaaaaaaaaaagaaaaaagaggctgggtgcagtggctcacgcctataatcccagcactttgggtaggccaaggcgagtggatcacgtgaggtcaggagttcaagaccagcctgaccaacatggtgaaactccgtctctactaaaaatacaaaaattagctgggcatggtggcaggcacctgtaatcccagctactcgggaggctgaggcaggagaatcacttgaaaccaggaggcagagtttgcagtgagctacgttcacaccactgcattccaccctcggttacagagtgagactccgtctccaaaaaaaaaaaaaaaaaagcatatacggcatacctgttccacttttgcacaaatattttatttctaaagtatgtctgggctctggactagggtgaatgaagttcagatcccagccctactatttcctggctgtagaatcttggtcacttactatttgttccaaacctttttgtcatcgtctgtaaaatgagaatggtaatattagcgtgcactgtttgtgggaggaggactggcaaaaatatgagagtaggagtttgggctcttgagcttgggcctggccttcaaatttccactctttcactcactagctaaggggccttgggcaagtaccttatcatgactgtgcctgtttcctcaaagagagtcatggtagtagtagtactcaaccgataggactgaagtgactattgcatgagtcagtattggcaaagaattcagaatagttcctggcatacagcactgtggaagcattagctagtattattatttcttatattgctgttgagcgcttgtcctagtgcttggcacatagtaactgctcaataaatattactttatatcattaaaatattagaggctgcccagccagttcctgagacatctactacaaaagaattgttcatggtttgattttgttttttacatgatttggatgatacaggaagagggactgggagttgtttgttcccctgcaggtagcccggcttcagtagaaggagaggaagccggccctgaggtctgggttatcatccccattcttatagcactttgttctgtttgcccaggcccattgctagaagactgggacataatcagccccaaagatgtcattggctccgacgtgttgctggctgagaaacggtcatcactgacgactgccgccctgccctttacacagtccatcctcactcaggtgttttcagggaccctagggacccagctgtggttggagggcagagccttcctggcaccctggttctgagcatgctggttggcatctgcccctagtccacacagctgatggtggcctccctccctcctcataggtgggccgtaccttgtctaaggtccaacaagtgctgagctggtcgtatggggaagatgtcaagcccttcaagccacccctgagcgatgctgagtttcacacgtacctgaaccacgagggccagctctcccgacccgaggagttgcgcctgcggatctatcatggcggtgtggagccctcgctgcgaaaggtgagcatcctcagtcatctgttgggtccatcactgctgcactcattaacagctcctgagacacatgcagtcagccacactgctgtgggcaagggtggagatgttacagggcacgaagttctctttaaggaggggcgagcagtcggaggcctagcagacttagaaggaagacagaggcccaaggggggtgggtgggtggcaactgatagacattggggtatggtttatctggagaactccagcctcatccctttcacccctgggcaggtggtgtggcggtacctgctgaacgtgtatccagatggactgacaggccgagagcggatggactacatgaaacgcaagagccgcgagtatgagcagctcaagagcgagtgggcccagcgagcgaaccctgaggacctggaattcatccgcagcacggtcctcaaggatgtactgcgcactgaccgggcccacccctactatgcggggcctgaggatggcccacatctacgggcgctgcacgacctgctcaccacctatgccgttacccacccacaggtgtcctactgccagggcatgagtgaccttgcctcacccatcctcgctgtcatggaccatgagggccatgcctttgtttgcttttgtggcatcatgaaacgcctggccgccaacttccaccctgacggccgcgccatggccaccaagtttgcacacttgaagctgttgctgcgacacgctgaccctgacttttatcaatacctgcaagaggcaggcgctgatgacctcttcttctgttaccgctggctgctgctggaactcaagcgtgagttcgccttcgacgatgccctccgcatgcttgaggtcacttggagttcgctgccccctgatcctcctgaacatgaggtagagctggttggaccccccagccaagtggcagacgctggttttggtggccacagggggtggcccgtgcgacagaggcacatgctgaggcctgctggtggaggaggtagtacctttgaagatgctgttgaccacctggccacagccagtcaggggcctggtggtggggggcgtctcctgagacaggccagcttggatggcctccagcaactcagggataacatgggctccaggagggaccctctggtccagctgccccacccagctgcccttatcagctccaagtccctctctgagcctttattgaactccccagacccactgctctcctccttttcccaccctgattccccatcttcctcatctccaccatccacccaggaggcctctcccactggtgatatggctgtaggatcccccttgatgcaagaggtaggctccccgaaagaccctggaaagtccctgccacctgtaccaccaatgggcctgcccccaccccaggagtttggccgggggaacccattcatgctgttcctctgcctggccatcctgctggagcaccgcgaccacatcatgcgcaatgggctggattataatgagctggccatgcactttgaccgccttgtgcgaaaacaccacctggggcgcgtcctgcgccgggctagggctctctttgctgattacctgcagtcagaggtgtgggactcagaggagggggctgaggccacagccgcatcttgatcaggctttctcaagccctccatcggccccaccagatctccattctttgccatgagggccaacacatgagaccccacctccctccctgcctgccagccctagacttgttggagcatagagcccttcctccccaggcctaagtatgtggagctctgctttggcactgccccgcagaggccacgcctatttattctgtttctgttgttttgtttttaacaactatactttgcacacatgaaggtcactgtggtttgtgtgtttctctgcctcctccctgggttttgctgtagatggagtcctcaggggccctttacctgatggaggggaaatacttcacttggtggagagaggctccagcttcccccttgtgatggggagagtggatgctgacaatcagttcccaaaggtgagcccaggtggagcactgcttgaggaaggcctgagtctgtttttttggtacatccatcggcctgtaagggtctgtattatggctgtgaatatatgttttcaggacagccccctggatgagagataagagagttcctggctcaaaaaaggacaagattctttactgagattgggaagtatgggctacttagaaacgttggagcagccacccctggcattccacatgtcaccatttctaggatcttggcctctctgtgaggtttatgcaccaatgctggcagccctgggcaggggcctcggcctcctttttgttttccacttcagacaggtaccgtgcagatgttaacaaggtttgagcgaggtgcatctcacacaagtgtgaaagcccaatcatcacattgttgaattacaaaaggatctagggctcctattcttgtcacttgctttggagccagtttgaaagactggcctagcccatgcctagcggccctaaactgggattccagctcacagcacctgtcttaaccatttcagcagtagaaaccacttatttaccttctccatctcactaatatggacaaacaacaagcactgataaaacgcaggccctaatagaattcacttcgttatttggaggataatgatcaaaaaaaggtcctttttcccactgacatgctcagagggtgggattctctcacaggccaggtgctgtcatccacaaaggatgggtgaaataactggggtcctcaggtcacggtctagccacaccagcttctcccaagtactaaccaggcttgaccctgcttagcttcagaggtcagacaagatctggcatgttcaggatggtatggctgtagaccaggctgggttctggccagagctgttgcactaggcaatgctgccagagatgaggaggcatcagggcagtcatcccttctgctgtttgccccaagaatgccatacaaacctggggatgacccttaaaagtctcccgtcacccccagtattggggggaagctgactattcctcagatgatagcccagtcacttgaagaacaggacaagactattctgtgtctagggggctcaagcactgtgtgtgggtctaacgaatgcattttgtggaaatgggctcagactccccaaagggccatccaacctatgggagtgtctggccttctgaggtcctgaaatgtctcttttgtcagtaaacagctaataccctctgggatgcattctgtgatttatgagctcaggtgtttgaaggaccagacaagccaattctgtggatagtagtttgggacctctgagagatagaagagtcctttctgtgaataggaggctcagataccctgaaaggcagaaacctctaatattcctctaggatacttggggtttctggttcctgcaaagatggcagacagcacaagctactgattcctttgcccgaaaccaactctggagaaactagagagggaaacatgggttccagaaattgcaacatagcaatgagagacccatggggaaatggaaggctgtctttaactggtgtgtgttttgacgggcggatggccagaggcagtaaatagaggataggttagggaaaaagatatttaagttctggctctcacctctcccctatattgccttggggaggtccttgtttgcccccttcattgcattaatcatccaaaccactggtacacatgtctgggggactaggatcagggcagcaagggccctgcaggggaaagaaataggcagccagaggaaatcagtcctccacctgtctccctccagacacccgggctggtggattacacctaaggagactgccacctctttttttttttttttttgagacagagtcttgctccatcacccaggctggagtgcagtggcgcgatctcagctcactgcaacctccgcctcccgggttcaaggaattctcctgtctcagcctcctgagtagctgggactacaggtgcctgccaccatgcctggttaattttgtattttagtaga[134 bp omitted]cggttttcctccgacggtttaaagatgaaccccacgctagggggattgtcaggtgtccaaagggcaggtgagcgggataactgtgcttctgtggtacctgtggctgtccagcctctggctcctctcccacacatccttttacccctggagctccaggtcattaagctgactcgagtcaggccttcagcctttcctcagtacgttctatcagccaggagagcggataatttcaggggcatgtaagttcaccaccaaaataaccagacaccagggcagtatgacttccaccaaagaaaaaataaactggacattctctagtgctggataacaaattaccccaaacttagccacttaaaacatcacagtttctgagctgggtgtggtggctcacacctgtaatcccagcactttgagaggcaaggcgggcagatcacctgaggtcaggtgtttgagaccagcctggccaacatggtgaaaccacgtctctactaaaaatacaaaaaattagctgggcatggtggcacacctgtagtcccagctacttgggaggctgaggcaagagaatcggttgagcccgggaggcggaggttgcagtgagccaagattgtgaccctgcactctagcctgggtgacagagtgagactctgcctccaaaaaaaaaaaaaaaacaataaaaaccatcacagtttctgagggtcaggaatctggaagcagcctagctgggtagttttgactcatggtctctcctgacgttttactcaagttggcagccaggactgcagtcagatgacagcttcacttggctgacagacccacttccaacatggcccactcatcgggcagttggcaaaaggcttcaatttctcaccacctgagcatctccgtggggctcctcacaacatgtcatcctaacgagcaggtgagaccgtgaccaagacggaagccacaatgtctaccttaacctcagaaaagacagaccatcatttctgctgtgttactggtcacatagaccaaccctagcacaacatgggaggggactatacagggcatgaataccaggaggcaggaatcatggggggctatattggaggccgcctcctacactgggtaacatataatatctgaagcagaagtattgagacagatgaaaaattttaaataaacataataaataaaaactattagaatatagggctgggcgtggtggctcacgcctgtaatcccaacactttgggaggccgaggtgggcagatcacaaggtcaggagatgacaccatcctggctaacatggggaaaccccgtatctactgaaaatagaaaaaattagccaggtgtggtggcacacgcctgtagtcccagctacttgggaggccgaggcaggacagtcgcttgcttgaacttgggaggcggaggttgcagtgagccgagataacgccactacactccagcctgggcgacacagcgagacgccatctcaaaaaaaaaattagaatacaaaacaggaactagagattataaaaaggacccccaaaaatgttaggtgtgagtatgatggtagagaaaaacaaaacagcccagcgtggtggctcacgcatgtaatcccagcactttgggaggccgaggcaggaacatcacttgagctcaagagtttaccagcctgggcaacgtggcaaaatcccatctctacataaaatacatctctacataaaatacgggtgtggtggtgtacccctatggccctggctacttgggaggctgaggtgggagaatcacttgagcccaggaggttgaagctgcagtgagctgagatcgtgccattgcactccagcctggatgacaaaagcaagaacctgtctcaaaaaaataataatacaaataaaaaaactgtaaatggagaatatggaatgagatgtcccagtagtaattacaaaaatatttgaaacacagagaccctcattggattaaaaaaaaaagtccaatagcatacacacacacaaagatttagaaatgttgaaaatgaaaggatggccgggcgcagtggctcacgcctgtaatcccaacactttgggaggctgaggcgggcggatcatgaggtcaggagatcaggagatcgagaccatcctggctaacatggtgaaaccctgtctctactaaaaacacaaaaaattagccgggcatggtggcaggcgcctgtagtcccaggtactcgggaagctgaggcaggagaatggcgtgaacccgggaggcggagcttgcagtgagccgagatcgcaccactgcaccactgcgctccagcctgggcgacagagcgagactccgtttcaaaaaaaaaaagagaaaaaaaattagccgggcgtggtggcggacgcctctagttccactgtagtcccagctgctcaggaggctgaggcaggagaatggcgtgaacccgggaggcagagcttgcagtaagccgagatcaggccactgcactccagcctgggtgacagagcaagactctgtctcaaaaaaaaaaaaacaaaaaacgaaaagatgaagaaaggatatggcacattaaaagcccaaagaaagctaagatagctatcctaatagctaagaaaataggtcgggtgcagtggctcttgcctataatcccagcactttgggaggccgagacggacagatcacttgaggcaaggagttcaagaccagcctggccaacatggtgcaaccccgtctctactaaaaatacaaaaattagcctagaatggtggcatatgcctataatcccagctacttaggaggctgaggcaggagaatcgcctgaacccaggaggcggaggttgcagtgagctgagattatgccactgcattccagcctgggtgacagatggagactctcaaaaagaaaaaagttggtaaaagagcagaggaacaaacccaaaggattgagtcatggaggaaataatacgaggaaggaaaaagatacaatagagaattgtaaagtaataataaagattaacagaataggccaggtgcggtggctcacacctgtaattccagcactttgggaggctaaggcaggcctatcacttgaggccaggagttcaagaccagcctggccaacatatgaaaccccatctctactaaaaatacaaaaattagctaggcatggtggtgcatgcctgtagtcccagctactcaggaggctgaggcaggagaattgcttgaacctgggaggcggaccggaggttgcagtgagccaagattgtgccactgcacaccagcctgggtgacagagtaagactccatctcaaaaaaaaaaaaaaaaaaaaacaccaggcacagtggctcaggcctgtaatcccagtgctttcagaggccga[137 bp omitted]caaggtggacagatcacctgaggtcaggagtttgagaccagactgaccaatatggagaaacctcgtctcctaaaaatacaaaattagccgggtgtggtggcgcatacctgtaatcccatctactcgggaggctgaggcaggagaatcatttgaacctgggaggcagaggttgtagtgggctgagattgcactccagcctgggtgacaaagcgagacttctcaaaaaaaaaaaaaaaagctggtactttgaaaataattaataatgatagacctttgccaagactgatttaaaacaatgcaatgcaaaatgcataacaaaggaaaattatagatacaaaaaggctacaaattgtaagctaatacacttgaaaacatagatgaaaaacaaaaatttcaggaaacattaaaatgtgttcaaatgaatgcaaaaagaaatagaaagcttgaatataacttgaatatacaataaattttaggaaaaattaaaatgataatcaaagataccccatcttattgtaataaacagcctcaggcccagccccagacggttttgcagattatagttctattaaactttcaaggaactgtaattcccatcttatacaaattgttccagaagataggaaaagagaaaaagccatacacctcattttatgaggctaaaatagttttgattctaaaaccagataaggaaaatactaaacagtaaatttatagacccactggacttatgaatatagatgcaaaaattctaataaaatattagctacctgaattcaatagtgcgttttgttttaaatcataagtagggtttatcccaggaatacaattgatccaaattagaaaattagtgaatgcaggccgggtgtggtggctcgcacttgtaatcccagtactttcggaggctg[132 bp omitted]gaggcaggagaatcgcttgaacctgggaggcggaggttgcagtgagccgagatcatgccactgcactccagcctaggtgtcagaggtagactccgtctaaaaaaaaaaaaaagaaaagaaaattagtgaatgcaatttaccatattaataaaggaagaaattatatgataatctcaaagcagaaaaggatttgataaggttcagtgcctgtttatgatatttaaaagggggctgggcatggtggctcgtgcctgtaatcctcatactttaggaagctgaggcaggtggatcacttgagcccaggagtttgagaccagcctgggcaacatggcaaaaccccatcactacaagaaaaaaaaaaaagaactctttgcaaacaaaagtagaagaaaacttctttaacttcatacatagcaaaatattacagcaaaaaatgcttaatagggaatttttttttttttgagacggaatctcactcttgttgcccaggctggagtgcgatggcacaatcatggctcactgcaacctccgcctcccgggttcaagcaattctcttgcttcagcctctcaagtagctgggattaacaggcgcccaccaccacacccagctaattttcgtatttttagtagagacagcatttcaccatgttggccaggctggtctcaaactcctgacctcaggtgatccactggcctcagcctcccaaagtgctgggattacaggcatgagccaccaaacctggccaatagagaatttttaaatgcatttccctttaagatcagggacaaggcaaggatgttcactcaatactactctttaatataaaaccacctaatgctatgaggaaaaataaatgaggtatacattgtagaaggaattgataaaactcatttgcaaattatatgagtgactaccttaaagaaccaacagagtcgggcgcggtggctcacgcctgtaatcccagcattttgggaggccgaggcgggcggatcacgaggtcaggagatggagaccatcctggctaacacggtgaaaccccatctctactaaaagcacaaaaaattagccaagtgtggtggcgggcacctgtagtcccagctactcaggaggctaaggcaggagaatggtgtgaacccgggaggtggagcttgcggtgagccaagattgtgccactgcactccagcctgggtgacagagcgagactccatctcaaaaaaaaaaaaaaaaagaacaaacagaatgacaaaaacaactaataggactaataagagagttcagcagccaggcgtggtggctcacacctgtaatccctgcactttgggaggctgaggcggatggatcacctgaggtcaggagttcgagatcagcatggccaacatgaggaaaccccatctctactaaaaatacaaaaaattagctgggcgtggtggcacgtgcctgtaatcccagctactcaggaggctgaggcaggagaatcacttggaacccgggaggtggagtttgcagtgagccgagatcgcaccactgcactccagccttggcaacaatagtaaaactccatcttaaaaaaaaaaaaaggggttcagcaaggtttcccaatacaaaatcaacatcaacctgtaaaaatcaaaagcatttctgtatagcagcaataaccaacaaaaaaaaaaagtaggaatgaatttaatacaagagacctctattttaaagaatttaaactctaacaatagaaattgatctgaataaaagagagacattttatgctctttgctggaaagattttggtaatatataagttatttttaacaaattatcccaaaacttagtggctaaaacaatacacatttattatttcacatggttttggagagtcaggattctgagagtggcttaactgggtggttctgactcagagcctctcatgaggctacaatcaggatgttggccaggactgcagttatctgaaggctgggatccacctttaagaaggcttgctcacatggctgttggcaagaggccttactttcttgccacctagatccctccatagggctgctcatgacataccagctaatgtcccacataatgagcagtctgtgtgacagagagcatgaagcagatgtgccttttacagcctggtcttggaaatgacacactatcacttccacctcattctgtgctttacaattgagtcactaagtccagcacacatgcaagtggaaggaagttaggctccaactcttgacgagtacagtatcagagtgtgaccatatcttaaaacctc[131 bp omitted]acaaaccccgtctctgctaaaaatacaaaattagccgagcataatggtgggtgcctgtagttccagctacccaggaggctgaagcaggagaattgcttgaacccgggaggcggaggttgcagtgagccgagattgcaccattttactccagcctgggcaacaagagcgaaactccatctcaaaaaaaaagacgttatttctcccaaaatgtaaaaattcaatgcactctcaataacacttccattacttttttttttaatgttttgaaacagggtctcactttgttgcccaggctggagtgcagtggcacgatcatagctcactgcagactccaactcctgggttcaagcgatcctcctgcctcagcctcccaggtagctgggatttgggcgagagccaccatgcctgacctcattacttctttttgttagaactgcaatacacttacattagaatttagaatagtaatgaatcatggacagttaagacagccttcaaagaaagcgttatgatggggatttgcccactagatattaagacatattaaaggtgttagtaataaaagggaaaaaaaaaacaacaacaaacctatattggcccaagagctaagaagtagaccaattagaagagaaggccgggcacggtggctcacacctgtaataccagcacttttggaggccgaggtgggcagatcacaaggtcaggagatccagaccacggtgaaaccccgcctctactaaaaaatacaaaaaaaaaaaattggctgggtgcggtagcaggcgcctgtagtcccagctactcgggaggctgaggcgtgaacctggaaggcagagcttacagtgagccgagatcgcgccactgcactccagcctgagcgacagagcgagactccgtctcaaaaaaaaagaccatcctggccaacatggtgaaaccccatctctactaaaaatacaaaaattagctgggcgtggttgcacgcgcctgtagtcccagctactcaggaggctgaggcaggaaaatcacttgaacccaggaggcggaggttgcagtgagccaagatcgcgccactgcactccagcctggcgacagagtgagactctgtcaaaaaaaaaaaaaaagctcagaagtcaggtacaatagtgctcccctgtaatcccagttactcaggaggctgagttggggagaatgcttgaggccaggagtcagcctgggctcatctcttaaaaacaacaataacaacaaaaccagcaacaaaccacctcagagacagacccatatatctatggaacttgatacatgatagaggtggtaaaacacacacagggatgggacagattgcttaatagatggtgatggggcatctggctcatgacacagagaaaaataaaattggagctctatctcacaccatatacaaggac[133 bp omitted]aaaaacctgtctctactaaaaatgcaaaaattagccaggtgtggtggcacacacctgtaatcctagctacgcagcaggctgaggcaggagaattgcttgaacccaggaggcggaggttgcagtgagccgagatagtgccattgcactccagcctgggcaacaagagcgaaactctgtcaaaaaaaaaaaaaaagaaagaaagaaagaaactgtaggggaacattttgt[143 bp omitted]aacctcatctctactaaaaatacaaaaattagctgggcatagtggcacatgcccgtaatcccagctactcaggagactaaagcaggagaatcacttgaacctgggaggcggaggttgcagtgagctgagatcatgccactgcactccagcctgagcgacagagtgagactccgtctcagaaaaaagcacagaacatagggggaaaaatgattatatcaaaattatggatctttattcaactaagtttactgcttacaaagttaataacacaaatgccagagctggagaggctatttccaacacctaagggattaataattagactatgtgaggaatccctgacaataacaggaagataaatatgggaattaccccaacaggaatatggatgtactgtattctgtatgttagcaaatttggtctgtgttgggcaaattcattctatggataagaaatttagcctctgagggcaaactaacttattcttcgttgatgtggcgctcagaagtgaaaaatctgtcaaatccatttattgtaaaggtggccaagacactgaagactaaattgtgaacagtgggctcagacactacttgattgggataagtctattgtgtattgcgaaagtcccttctgtgaatcaagggctcagttactttttttttttttttgagactgagtcttgctctgtcgcccaagctggagtgcagtggcatgatctcagctcactgcaacctccacctcccgggttcaagcgattatcccgcctcagcctcctgagtagctgggactacaggtgcctaccaccacgcccggctaatttttttttttttttgtattgttagtagagacagggtttcaccatattggccagggtagtcttgaactcctgaccttgtgatctgcccacttcggcctcccaaagtgctgggattacaggcatgagccactgcgcccggcaagggctcagttactttcgaagagagcaaaaattgctctatggattgggatttacaacctctgaagatcgtagcatcctcttttgttttgttttgttttcacccaggctggagtgcaatggcgtggtctcggctcactgcaacctccgcctcccgggttcaagcgattttccagcctcagcctcccgagtaggtgggactacaggcacgtgccaccacacccagctaattttttttttctttttttttttttttttttttttttgtatttttagtagagatggggtttcaccatgttggccatgcaggtctcgaactcctgaactcgtgaaccgcccgctttggcctcccaaagtgctgggaatacaggcgtgagccaccgcgcccggccagcatcctgttttgtaaaagccatctcaggcagtctattggtgagaaaattaaggggctggcttcacgccagcagtcagacaagggtgagggctgaagtcagagatgagatggaatgacgccagggaaaagggtcccatgacaggcggctagatgttgagcacagaggagaaagagtaggagtcagggtcaaaccttaaaacgttgggtctgacatcatggactgtgaagggtgatgacatcagtgacggtgggggataaaatgtcaggcctttaaagggtatgaggttaaagaactagaaggtgaaggaggttaacatcagagaatggcagggacctagaggaagacgactacgatggtgaggaagacatccgatccagcgggggaaatgatggcaaggacgggaggatgatgtcagggacagcaagtagtatgagattgagaaggttcctttgtggaagggataaaggcagctcagccggttgtgggggggatgctgacgtttagggtgcaccagctgttcaaaagtcgaccccatttccggaaacaccccatttccggaaacaccccatttcgcggagaacactgctcccttcgctttgctgtcccttcctctccccaccactccgctcctgctggcctcagccaatcagcacgcacgccgggacgcgcaaggggaacgttccgggacgttctcgctacgtactctttatcaatcgtcttccggcgcagccccgtccctgttttttgtgctcctccgagctcgctgttcgtccgggttttttacgttttaatttccaggtaagttgcatatgtcctgcgaaacggcggctcctcgccacacacgcgccgcgccggccgtgaccggggaatagcgagtggggagagtaatggccactgacacgtaggcttggctttctctgggacgggcgggtcccgtgcttggaggtgaaacatttcggttggtgggaggccggcgcgctgtatctgagtgtgaggcctaccgggagggactggtggcgtcggtggtggcagtgaccacgcgacagccgacacttactttccttatcccacgtggccgccgccatcttgttctgccggcgttaagggaacgcagggatgttctgggcttgcgcagtggcacaaaatgacgggcgtggcggctatgaatgtgagagcatgcgcaatgtggccccctaatggtggctgcgctgagccagctcctcagattaccaccttattggccgcctttctcagcttttctgtagttacccatattttgttcctctttcttgtctattttctgtgctttttctctgctttccgtctcgctattttctcacatctccattttctttctccttcctgccaccattcttcatgttcttcccacaggacttgaactgccatgtcctctgaagaaggaaagctcttcgtgggagggctcaactttaacaccgacgagcaggcactggaagaccacttcagcagtttcggacctatctctgagggtgagacgggccatactcacaatgggggttggtgagagaaagtctgggatccttgcatttcaaggagtattaactgaaaagttaggacccacgcctccaaattctttttcttcctaagcctatggtgtagactaaggatgaggggaagcgtctttgggattagtgggagcgctccgttttccctacctatgccatctccttttccggccaccctttgctacttaacctttggggtactgactggtccacattgctccatcttctctccctctcacagtggtcgttgtcaaggaccgggagactcagcggtccaggggttttggtttcatcaccttcaccaacccagagcatgcttcagttgccatgagagccatgaacggagaggtggggcctcctatctgcagagggaccttgtccccatctgcggcttccttcattctttttgtttttccctctgtgtctgctcggggcagcgtggccaccaagccccgcagtgcccactcacaggagcatgactgccttttgttctagggggtggagggcagcggcagacagagcctggccgcctgggaggcgacgactggtcctgcatgaggccgagaagccacctgtggatggttgacctgccttgggcttaggtagtagagtctgcagacctgtgggcctggcccggagaggacctcgtgagtcttctgacatggactctgaagcctcaaaccaagagaggtgtctgtctagccctgatagtcgggcagcttagaggagtggggaggagaactcagcctgagttcagtcaagatgtaagtagtagcaaggggaacatggtgcattcaggtcattttgtgtgggattctatagctcctgatgaagccattctggggtaaaggagcttattctggaacatggcacccagaacctggtgcccagcaggaatttttggcctcttttgcccacttacccttgcctgctcttccctcaccattgccctgactgactgccaacccatcatccttgtgtctcccacacttagtctctggatggtcgtcagatccgtgtggatcatgcaggcaagtctgctcggggaaccagaggaggtggctttggggcccatgggcgtggtcgcagctactctagaggtgagtgcagtgatcgttttgatcatggggtgagagggagagttgcctatgtgtggacaactgccatttaaatatttttctgctctaggtggtggggaccagggctatgggagtggcaggtattatgacagtcgacctggagggtatggatatggatatggacgttccagagactataatggcaggtgggtagccaaagggctgggatgttctcctattgcttccctctccttaagaactcagcgcctgggtgttcatgcataccacaccttgctgttactaatgtgtacctaaaatgagtatgaaatttagcattttaagttaattgtgtagtcatatagttgcgacatggtaaagtatactatatatgttgtgctgtgtgggttatataactatattgctttaacatgtaatatgatttaatatactgcgtataaatcgtatgccataaaactgtttactgtgatactcatatgcttaacatatcctgtttttgatacgtaaggtttatgttatgacccatactgtaaaatgtgacgcatataattacagtggtatatataatgcagtaccagaaaacttttgtgtgttttttttcccccccagaaaccagggtggttatgaccgctactcaggaggaaattacagagacaattatgacaactgaaatgagacatgcacataatataggtgagacttggatatcggcattgagtgaacctgtttgtcacactctgtcatgaccctctcaccttttctggcaagactgctctgcatttctgctgccctcatacctcacccagccaacctaccaaacattcctagctaggccttccttgctctcaggtgcatatcagagcaagtttgctagggggtgggatctgaaaacccatctcctataatcttctactcttgtgtgggatggaggaaatgaaggtgtgtccctgttgtccaaccctcagcatcttcatcagctctaggaggtgagcatgttgtcagctgttacttcatgacatcacaattctccccctcttgctgttcccagatacacaaggaataatttctgatccaggatcgtccttccaaatggctgtatttataaaggtttttggagctgcaccgaagcatcttattttatagtatatcaaccttttgtttttaaattgacctgccaaggtagctgaagaccttttagacagttccatctttttttttaaattttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccagcggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctgagaacaaactgctttattcttactcagcccattttgcaaattaaaagtgggggcagaggtgggcggatcacctgaggtcaggagttcgagaccagcctggccaacagggcaaaaccccatctctactaaaaatacaaaagttagcggggcgtggtggcgggtgcatgtaatcccagctactcgggaggctgaggcaggagaattgcttgaacccaggaggcggaagttgcagtgagctgagattgtgccactgcactccagcctaggtgacagcaagactctgtctcaaaaaaaaaaaaatggcacatcaacgagagggaggcttggagaatatttggttggtgggtgggcagggactgccagagggttaggtgtacattgaggcctgaggcctgctggaattgggtttccttaactggtctcttatcttagtcccattgttctgagaacataagcacctaatctcatggcgtgagctaatccctatcataaatagtggtaccagttcattccttcccctgaaatgatgggggttgggcagagatgcactgaactcatctttgtgtatgagggccatgagagaggcctggtttgaaaacaatgctaagagctcagattccaggatttatgtaggggctcttctacttcccaggtatttgacctcaggtgagtcatttaatttcagccttatgccattttacattttctgtggagggttaggttaattggcatataaagccactgagaagagttggcaaagctctcagtcacggggatttgatcttttttggtgtgtgtgtgtcttgggtggtaaagtggtaattttgtaattctagctggtcttagttcctcagttctgctccctttagtcatggttctttctagtggctgtattgaggccccatgggtgttatccctccattggttctagtttggaacagaaaaatctgttgtattcatggctttcacctggctaatactgagctaagttaccaccaggttgcaaactccaggacattattgtcctgagctgcctattcccttgctggtgcgttgtggaaccctgtattattagttccagtcctggaggcctgcctcctgagtttcccagctagttgggacaggccccaatatcccttcttcctgtaacccaaacagtcatgaatttgctttggcaggtggatggagacttgggaacttccacctcacccactaagccaggcccaggctatggggcattgtggctaaccccaccaggtggatacttggtctgaggacgcatcttattctgggcctttagggagctaaggcagtgagaattggcaggaggactgctgtgaatgccttgtaggtcgggggattggagggggtcctctgctccctgtctctcaggatggcaatgtacctctcacccccagtgtcagctgaggtaggatccataatcagtaatattcctgcaacaaaatgttcctaagtggaatcaatgaagaccaaaatttatttgtataacaactctaaacctgctctgctctgctgtgtttacaatgtgctttgtgatcatccagcccagggagtcccagtctctggctgtctatctgctctaaggaagagagcccacagttctctatagtgccatagtctgtgatgaataaagttccagatttgaggtcaacccccgaccacccttaaagtgcttgttggtctcctactttggtttgtcttcagcatccaactgatgcacatttgtcaagaacccactgaggctagaaaccccccaaacactcaaggtaccttgagaacatgtatcccaagacctgcaaagaccaaacacatggcctgtaactacttttcactttcaagccctggaacttgtctgtaccaaaaatctttctgaaccattcaccaaatctcttgtcaagggccagaataaattaagagattggcttttggttttcaattaggctttcaagtcctaagcccaacccctcctatcccacctaggcagaaatcacttcagatccttgcttcctagtttaatttcttctctgcctcagttataacatccataaaatggaaataataatacccacctcacacaggggttaggagtgtttttttgttggtttttttccagacagggtctcactctgtctcccaggctggagtgcagtggcacaatctcggctcactgtaccctccgcctcccaggttcaagcagttctcatgcctcagcctcccaagtagctgggattacaggtgcctgccaccacgcccggctaatttttgtattaataga[154 bp omitted]catcaaacagctccacacccttgttccatgttctggattggggagttgtgggggtggaggtgtagaacttttaaaaagcttcttaaaataagttgctgtgaatacttcaggtatataaaaaaacattggttgacaataagccagtgttctgccattcttacctgcttatcaagacaaaacctgctcaagtccctgcccagctgcattccaagtgttttcaagtttggtggtaagacctgacctgaggcttcttataacctttactcagtgggaatatgcatacagttcactacagaaatatttgtatttacttagaggaagtgccctggatctgggggcgggggggggcggggggaatgggtcttttctaaattgttaaaagcagttcatgccattattcttaataaacatttctaatatgctgtgaaagagtatattcgtttttttaatgcatatatccatttactcattgttcccatgaaagagccttgtatgcaaacctccaaatgccgaaggagccaagaaacaaggcagacaaaaattgttagtaaagggttctttactggggggacttagaagcatgacgtggggacgggcgcagtggctcacacctgtcatcccaacactttgggaagccgaggtgggtggatcacctgatgtcaggagtttgagaccagcctggccaacatgatgaaaccccgtctctactaaatacaaaaattaatcgagtgtagtggcgcacaccaagtaatcccagcttcttgggaggctgaggcacaagaatggcttgaacccgggaggtggagattgcagtgagcccagatcgtgccactgcactccagcctgagcgacagagcacaactgtctcaaaaataagcatggccttgggtggcagcaagataaccatgctgttgctcttcaacccacggcttacataccatagggaaagagtgtgctcaagatgaaggcaactccagaacaggcataatactctatgcatcatcatctaatttgtgcgataatgtaaaagttgacaagctcttttttttttttttttttttgaaacggagtctcgctctgtggccctggctgtggcgcgatctgggctttctgtggcccaggctggagtactgtggcgcgatctgggctcactgcaagctccgcctcccgggttcatgccattctcctgcctcagcctccggagtagctgggactacaggagcccgccactacgcccggctatttttttgtattttttagtagagaggaggtttcaccgtgttag[133 bp omitted]gcatttacaggactggcgctagtcagaagtaaacgtggtggattggcatccaagatggagtaacttttgtctccacactcttgctgaaggctggaaaatcagcatgtgagtctgt[140 bp omitted]aacatggtgaaaccccatctctacaaaagtacacaaattagccaggcctaattgcaggcacctgtaatcccagctactcgggaggctgaggtgggagagttgcttgaaccagggaggcagaggttgcagtgagccgagattgcgccattgcattccagcctgggtgacagagtgagactctgtctcaaaaaaaaaaggaaaaccatttggtaaaggagaaagtggagtcctagacgggggagttcagtgtcagcctgcattgaaatcatccggtttatgggacttggttgccttgtgtgctggcttggactccatggtatccaaagtgcacagtgcatgaaacatgaagaatttgcaacttaacatcagtttatatgttgctatccaagtttatctaccatgaggcttaactcatacaaaaacctttacttagggaatgtgcctacttgagaaagcaagttcacctactcatcatccagctattttccttgctagttatcatagataacatgaaaagattttttagagtttacccatgtccttcaaattatcccacacaaaactgcttagaatgtgttaaactatattgatgatttaaaaacaagcacaacaacataaagacagaatcttcctctatttcaggagaaatgatttactgtgaatttaaccttttaacatctttggtgttaattgtgggtgaaccaggatggctgcttcctgtctcgttctatgatcctcaccctgatcttgttcagacagcgtcgctcccatgtacaacaccatagtctctacagtgggagccttaaaagggccctcttgtttccctatctgtcgtctgacttctgcagtgtccctgcccaccttctcatagcagtggccccaaaggacatgtttctgttacaggtgatcacattcagaacaaatgtctatattttttaaatgtaagtacatctgggctgggtgcggtggctcacacctgtaattccaccactttaggaggctgaggcaggaggaacgcttgaacccagaagttccaaaccaacccgggcaacacagtgaggcgcacccgccacctgccccctgcccctgttaaaccaaaataaaaattagccgggtgtgatggtgcacgcctgtggtcctagctacttgggaggctgaggtgggaggactgcttgagcctggaaggtctaggctgcggtgagtggcattttggcctgggtaacagcgagaccctgtctcaataaaaaaacaaaacaaaacaaaacaaaaccgcgtaatattcaccctatattcacactgtcaatattcacactataagatcaattaatgcccctactataagcttgtttagcaaatcttttcttttactttttttttttttttgagatgacatcttgctctgtcatccaggctggaatgcagtggcatgatcacagctcactctagcctcgacctcccaggcttaagcaatccccccacctcagcctccagagtagctggaattacagggatgcatcacccatgcccaataatcttttttggtttttgtagagacagggtctcactatatttatgttgtccaggatggtctcaaacttctggactcaagcaatcctcctaccttggcctccaaaagtgctaggattacaggtgtgagccaccatgcccagtcttatttagcaaatcttttctggattattagtccttttttgatggaaacttttcacattaattttttgcccagctcttttgaggtgt[141 bp omitted]tgaaaccccatctctactaaaaatacaaaaattagccaggtatggtggcgcatgcctgtaatcccagctacgcgggaggctgaggcaggagaaattccatgaagccaggaggtgcaggttgcactgagccgagatcgtgccactgcactccagcctgggcaacaaagtaagactccatctcaaaaaaaaaaaaaaaagatgtataacagggtgtttgataaatatacacatttaaaatgatcactacaataaagcaaattaacacatctatcaccttagttacctttattgtgagtgaaatgagaacacttaatcatctacttagacaatttcaagtatacaccacagtgttattaactatagtcaccatgctgtacattggatctccagaacttactcatgttataactgaaagcttgtacccattgaccaaaaattcccccagcccttagtaaccaccattgtactccatttctatgagtttgactttttttaggctgcagatacaagtgagatcatgcagtacttgtctttctacgagtggcttatttcacttagcataatgtcctccatccatgttgcaaatggcagaatttccttttttaaggctgaataatattccactgtacatatacacatcatttactttatccactcatctgccatggacatttgggttgtttccacgttttggctattgtgagtaatgctacaatgaacatggaagtgcatatatctctgagatagtaatttcataacttttggatatatacctggaagtaggattgctggatgctatggtagtttatttttttttattattattattttttt[135 bp omitted]catgcccggttaatgttttgtatagtag[143 bp omitted]cctccacacaattttccctactagctgtactaatttacattcctacaatagtgtataggagttcccttcagcacttgttatctttcctatttttttttttttttttgacatggaatctcactctctcacccaggctggagtgcaatggtgcaatctcagctcactacaacctccgcctcctgggttcaagcgattctcctgcctcagcctcccgagtagttggtgttacaggtgcccaccaccacacccagctaatttttgtaccttaagtagagatggggttttgccacgtcagccaggctggtctcgaactcctgagctcaggcaatccacctgcctcggcctcccgaagtgctgggactacaggcatgagccaccatgtctggtcctttcctcatttttatagtgaccatcctaataggtatgagttgatatctcattgtggttttgatttgcatttccctgatgattagtgatgttgagcccctttttgtatacctggtggccatttgtatgttttctttggagaaatgtcttttcaggtactttggctattttaaaatcagtttatttggggttttgctattgagttatatgagttccttatatattttggatattaatcccttataagataaatggtttgaaaatattttcttccattccataggttgccttttcattttgtagattgtttttcctttgctgtgcagaaattttttagtttgatgtagtcccacttgcttatttttttaacacagagtcttgcccaggctagagtgcagtggcacgatctcgggctcaacctccgcctcccaggttcaagcgattctcctgcctcagcctcctgagtagctggaactacaggtgtgcaccaccacgcccggctaatttttgtatttttagtatagatggagtttca[133 bp omitted]ggtttcatgtccaaagaatcatcgataagaccaatgtcgaggagttttcccccttggtttccttctaggacttttatggcttcagatcttatgtttaagtctttaatccatttttagtttttgtgtatggtgtaagataagggtccatcatttttcccagcaccatttattgaagactgtctttcctccattgtgtattcatagcacttctgtcaaagattagttgatactagctgggcgcggtggctcccctctgtaatcccagcactttgggaggccaaggcaggcggatcacgaggtcaggagtttgagatcagcctggccaacatggtgaaaccctgtctctactaaaaatacaaaaaaaaaaaaaaaatagccgggcatggtgacacatgcctgtaatcccagctacttgggaggccgaggcaggagaatcgcttgaacccaggaggcagaggttgcagtgagccgagatcgcacctctgcactccagcttgggcaacagagcaagactccgtcttgggtggcgggggataagattagtttatattgtatgtgtgggtttatttctgggctctcttgggttttgggggttggtttttgttttttgtttttatcaggcagcctcccaagccagagtaggctcagagagactccctattttctgggcccttgatcctgttccactgggtgtgtgtgtgtgtgtgtgtgtgtgcatgcgtgtgtgtgtgtttaaagagggtcttgctctgttgcccaggctggagtccagtaacacaatcacagctcactacagtctcgaactcctgggctcaagcagtcctcccacctcagcctccccagcagctaggactatgagcacacaccaccatgcccagctattttttttttttttgagactgttacactcttgttgcccaggatggagtgcaatggcgcgatctcggctcaccacaacctctgcctcccaggttcaagcaatcctcctgcctcagcctcccgagtagctgggattacaggcatgcaccaccacacccggctaattttgtatttttagtaaagatgggggtgctccatatt[137 bp omitted]tatagtcaccctattgtcctgtcaaagactagatcttattcattctttctattttttgtacccattaaccatccccacctcctcccacccccactaccatttatctgactttggcatcagggtaattctgttctcataaaatgagtttggaagtgttccctcttcttcaattttttttttccttttttgagacggagtctcactctgccgcctaggctggagtggtttgatctcggctctcactgcaacctccacctcccacgaccaagcaattttcttgccta[224 bp omitted]ttatcagtctgttcagattttctattcctgattcggtcttggtagagtgtatatttctaggaatgtgtccattgtttctaggttatccaatttgtgtaacaactgttcatagtagtgtttagtaggcttattattattatttgagatagggtctcactctgtcgcccaggctggagtgcagtggcacaatcacggctcactgtagcttcaacctcccaggcttaagtgatccttcccgcctcagcctcctggatagctgggattacagacacacatcaccatgcctggctaggttttgtatttttagtagagatggagtttcgccgtgttggccaggctggtctcgaactcctgacctcaagtgatcttcccacctcagcctctcaaagtgctgggattacaggcgttagccactgtgcctggcaggtcctttgtttttctgtcgtttcacttgtaatgtttctgattttatttactttgttcatcttttcaaaaaaccaactcttagtgtcattaatcttttatatttttttcatctatttcatttatttttgccctgattttgttatttccatctttctgctaactttggacttcattatttttctagtcccttgaggtataaagttaggttgtttatttgagatctttatttcttttttcttttttttttttttttttttttgggacagggtcttgctctgtcacccaggctggagtgcagtggcaagatcacagctcactgcaacctccacctcctgagctctagggatcctcccacctcagcctcccaagtagctgagactacaggcgcacaccaccatgcccagctaattcttttattttttgtagagacaagggtctcactatgttgctaaggctggtgttgaattcctggccacaagagatcttcctggcggggtgcagtggctcatgcctgtaatcctagcactttgggaggccgaggtgggcaaatcacttgaggtcaggagtttgagaccagcctggccagcatggtgaaacccctctctactaaaaatacaaaaaattagccaggcgtggtggcaggcgcctgtaatcccagctgcttgggaggctgaggcaggagaatcgcttgaacctggcaggcagaggttgcagtgagcagagagagtgccactgcattccagacagagtgagactccgtctcaaaaaaaaaaaaaaaaaaaacagctcttcctgtcttggcctcccaaagtgctggaattaacaggcatgagccaccgtgcccagccagaagtgtattgtttaatttccacatattggtgagtgttctgattttcctccttttattgatttctacttttataccattgtggtcagaaaggctcttgatatgatttcattcttcttaaatttgttaaaacttgattttgtgaagtttcattatatcatgcattggtggggtccacctacaataagctaaaacattgccgtgtaatgtaatgttagggagtgggaagcattaagggaaataaagcagggtgggggtggagagtgagatgtgatggtttacacatggcagtcagggaaggtgactctgaaaaggtgcctttcaacagagacccgatgttcgagggagagcagtcaaggaggatatccagtggtctagttcgtgggaatggttcctccatagcgctctggctccgttgcacgtctccacatgggccacgtaggtaagctgatgtaagtcttggcagaacgccctgtaatcctcggaacacagagcacggaaggtctgtggggaattctcacgaggccatttaccattcacctcctatctaccaaggagcctgttgtgagacagttttctccccacctcctgaggttctggtggggtttgaggctttctacccctcacctctgggctatagaactgcttagctgcagcatgaaattagctcctcagcaacaaggtgtcctgccacctggtgtgtggtcatctcgcccctttcatttcggtgttgcccggcacaagggacatgaaccagaatctgtggatgttcttgctttcgtggtccacgtaagtaacatctgaatgtaactagggcttgtttcatttccaaccaaacctgtcagccttaccttgcttcgacatctggaagagaattaaaggcagagggaaaagcaaacaggtgcaaaggccctgaggcaggagcttgcttggtgtgtggggaacagcaagaaagccagcggggcaggagcagagtgagccaggggccagtggtgggtggtgaggtcagggagggcccggagggcctcgtgggccacggagaggactttggctttttctctgagagagatgagagccacggcagggctctgagcagaggagggccctgggctgacttgggttgcaacaggatcattctggctgccgtgaggacagattgaggagagggggcgaggacggcagtggtgaggaggctgctgcagtcatccaaaccagtgatggtggtggcggcagtggacgccgagaggagagctcggattctggcatattctgaaggtggaactcacagggtttgctgacagatcaagcaaagcgagggcgggatgacaaagtacttgttaggaatccacactagatgagctcacaaaaagtaacttgacagttggtgttagtgttgtggttaagaacagggattcggagccaagtggcctacatataaatccagttccattgcttactggctgtgtgaccttgggcaggtcacttcctctctttgttttcatttcctcacctgtgagatgagatggcaatagtatctacttcacaagactgctgttgtaaggattacac[143 bp omitted]tctactaaaaatacaaaaattagctaggcatggtggcgcatgcctgtaatcccagctactcggaaggccgaggcaggataactgcttgaactcgggaggcagaggttgcagtgaaccgagattgcgccattgcactccagcctgaatgacagtgagactgtctcaaaaaaataacaaattaaaatgaataaataaataaataaagtgcttcaaagagtgcctggcataaataaagtgcttgttattagtgacatgaccatgggatgagaagtgtcagggaagtgagtcatagcaaagagcattccagataccaggaacactttgtacagttttcaaagcatgtgacaggaagccagcgtggctggaacataacctgatggagtaagagtgccaagaggtgaggttggagaggaagcctaggaggagatcagcccctcacggtagctggacgccattgcagaccttggtgcatagagcagtcctggaggtcagaagagaccaggaacagaactagatctgggacttagtgctgggggtgcacagagctaggagaaggacggggcattattgtcaacaatgctggctggttaccagtggttggtggtttctggtgtccaggataagaaacagtctagttcgagcagtaggacaaatacctaacgcatgcggggcttaaaacctagatgatgcgtggataggtggagcaaaccaccatggcacatgtatacctatgtaacaaacctgcatgttctgcacaggtatcccagaacttaaagtaaaaaacaaacaaacaaaaaaaaacaaaacagttcgacttcccactggagtccaaatactagttctaatattgtctacatctgtggccatgggcagtaaacccctctagagttcactttccctatcttcaaaatggggcttaaatgtcatacctacctccttaggtttgtgacagtacatataagatcagtatagtcagcactcagtaatgcaggctatcaccacaaccaggtgggacctatcccaggacagcaagggtggcttgacatttgaaaagcatgagatgtagttcaacatattagcaggaaagaaagagaatcaagggctgtaattgcctgggactgtgatatcagatgcaagggctaaacactcccagatctgcaatctagccctgaatgcctcactgggcaagctgaattgagatcttaagaccagagtgatcctagtcctacccctgtgaagtgatttccgctggctctgaatccgtggccgacaggctttaacgtccgccttatcctcacgctcagcagtccaaggctttgtgcattctggtttcagttcaaatttatttttcacacctgccccccagcaacaataaccaaactactatttttttttttaagaagagtctcactctgttgcccaggctggagtgcagtggcgtgatctcggctcacttcaaccttcacctcccaggttcaagcgattctcctgcctcagcctcctcagtagctgggataacaggcacccaccaccatgcccagctaatttttctacttttagtagagatggggtttcaccatgttgagcaggctggtctcaaactcctggcctcaagtgatccacccgcatggcctcccaaagtgttgggattacaggcatgagtcgccatgcccggccaaactactatttcatttacaagtttaccaatttcttacattattattttcttactattgatcttggcagttagaatcgtagctccagggactgaagaagtatctgtcagaaggctggcttgctagttcagcacgctggggaccgcacagtgctccgtttgaggctttttccaaaggcagaaattttatttctgacttagggcatagagagttgtcaccaacccccatttgggggttgtgagaactttggcttcagaggcaaatgttttcccatcaggaaatgatgaaagttatgaactcatatcccaacccccactcaccccatttaggaagaaacttcagggatgagataagtgaatgaggattccgtgtctccactccaattacacctcagctccatggctcctcccgtttctctctctggccttgattctcagcacacctgtaccctgaaccacctacactttcccacctacacttttactttgtcctctgaagttggggcccaacttgagattttatttcagcctgtggtagcaatgaaaagcagacacagccaatgtggtccactgcgttcctttgcatttcttgtttttttttttttgtttgtttgtttgttttttttttgagacagggtctcactgcgttgcccaggctggagtgcagtggtgtgatcacggttcactgcagcctcaacttcgcaggctccagtgatctcccacctcagcctcttgaatagctgggactacaggtgtacaccatcatgcctggttatttttttttattttgtaaagatagagtctcaccatgctgtcaggcaggtctcaaactttgaaaactaaccgaaagcttgtaacaagcagaggaatgtttaatcaagaaaaaccagctgagtggctcatgcctgtaatccagcacttcgggaggccaaggcaggcaaatcacgtgaggtcaggagttcgagaccagcctggccaatatggtgaaacccatctctactaaaaacacaaaaattagcctggcatggtagtgcacgattgtagtcccagctacttgggaggctaaggcacgagaatcgcttgagctgggaggcagaggtgcccatgttggcgaggctggtctctaactcctggcctcaagtgacccaccctcctcagcctcccaaagtggtgggattacaggcgtgagccacagtgcccagccaacaaacctttcatcagcttgttttgtctagtatcttatagccttataggaagaggttttaaaaataatttttataaatttaatatgttaatattgaaaaacaataaaagaattcattccaatggtgaaacagaatttcccaggtatccctgactcgaattcctgactcttctgttatttcattccatcatatttctttggaagcagagtggtgggatgaaggggcagggctctgttgagagaaggtggaagtgaatgggaaaggtatttatcacaacactctttatggtgaaaaaagaacatggaaataaacccaatgccagtcacaaataggggaccagttcagggctgggtgcagtggctcatgcctgtaaatctcagctccttgggaggctgaggtggaaggatgcctcaaggccacgagttcgagaccagcctgggcaacatatcaagatacccccatatctctctctttttaaaaaaaacaaaaaaaaaaaacaaaaaaaaaaaacagggtcttactctaacatccaagccagagtgcagtggcatggctcactgcagccttgacctcccaggctcaagcaatcctcccacctcaccctcctgagtagctgggactatgagcacacaccaccacacccagctaattttatttttgtagagatgtagtctcactgtgttgcccaggctggtctcaaactcctagactcaagtgatcttcttgccttggcctcccaaagtattgggattacaggtacgagccaccatgcccagccgaccccatgtcgctctctcttttttaattaatttatgtttgagatggagtttcgctcttgttgcccaggctggagtgcaatggcacgatctcagctcactgcaacctccgcctccagggttcaagtgattgtccttgcctcagtctcccaagtagctgggattacaggctcctgccaccatgcccggctaattttttgtatttttagtagagacagagtttcaccatgttgcccaggctggtctcgaattcctaacctcaggtgatctgcccgcctcagcctcccaaagtgctgggattacaggtgtgagccaccacatccgacctctttttttttttttaagagacagggtctcgctctgttgcccaggttggagtgtagtggcatgatcacagctcactgcagccttaacctcccaggctcaagcaattcttctgcctcagcctcccgagtagctgggactacagggatgtaccaccatgcctaatttttggtagagatggggtctcactttgttccccaggctggtctcaacttcctggactcaagtgatcctcccgcctcagccttccaaagtgctgggattacagacataagccactacgcccagttgacaccatgtcttaaaaaaaaaaaaaaaaaaaaaaacgtaagggaaccagttcaataaaatgtcacccttgaattccctgggcttcagatatcctcatctgtaaaatggggatagtaacaggacccacaaccttcagttattatgattaaattgactgggtacagtggctcacgcctgtaatcctagcacttagggaggccgaggcgggcgaatcacttgagctcaggagtttgagaccagcctggccaacatggtgaaaccccgtctctaccaaaaatagaaaaattatccgggcgtggtggcaaatgtctgtggtcccagctcccgggaggctgaggtaggaggactgcttgagcccaggtggcagagattgcagtgagccaagatcgtgtcactgcactccagcctgggtgacagagtgaaaccccatctcaaaaaaaaaaaaaagattaaatagattaatatatgtataaaataccttgaacagtacccagcacattgtctcataaatattagttgttcttgttaaggttacatgtttgtgcagtgaaatagagtttactctttatcaatcatgttacaaaagagtatttaatatgaaaagacactgataagcttgttacagggacaagggagatgctgagtcaacacaatacagtgtgatctttcggtgactttaaaacattgttgaattgattgtatttgttataaaaataatgtggaaaataacagctttgaattttatgtcagttgatgttaagatccaacaggaagtttaccctgataacgttaagatgaacagtttgaaagcagcttcctgctggaagttgaaatagagatgattcagatagcctctttggatccaaaccccaaagcttct[147 bp omitted]cccctctctactaaaaacacaaaaatttagccaggcgtggtgtcggacgcctgtagtcccagctacttgggaggctgaggcaggagaatggcgtgaacccaggaggcggagcttgcaatgagccgagatcgcgccactggactccagcctgggcgacagagcgagactcccgtctcaaaaagaaaaaaaaaaaaaaaaaagaaagaaactcaagcctcaagctgtctgggggcatccaagtccaaccatcccagtcacacacacacaaccgaccttactcatcccaggggtgtgcagaggcccactgcaagaactggtgaactttcaaggcgtctttgcatatatgatgattttttattctattattcaagttttgcttggacaagattgtgctgctaaaaagtggcctacaccactttttttgtttttgtttttgagacagggtttcactcccgtcgcccaggctagagtgcagtggcgcgatctcagctcactacaacctccgcgtcctgggctcaagcaatcctcctgccac[225 bp omitted]atgttgtacttctgatttctagggaatgattagcaaactcacccctgacgctatgtcccttggacattatccttgtatacacaaaaagtgcaattaacgagtgggtagaagtcaaggggtggagcctccgtccttgggcttgaagccaatgtccctcaatgcgcctgcgagactcccacgccctgggaaggatgcctatcgattcgctctgggctcggcagttctttctgatagcaggcagccatcttgcctggagcctgagaaagggaggagagacagaaggaaccggcgacagtggtctcagggccgctccggggggcctcaagaaccggaggcagccccggaggtggtccccgatcccgggctatgctcttggatctgagaagggaaggcggagggcggcggggacaagatgggtggagaatgtcaagcaaggaatgctaggcgggggaggggcgttgctatggcgactggggaggggcggtgtctgttctgaatcgctgtgtgtcacccgggcgctgcccaggaagggcagggctggggtgatgaccatggtaacacccgggggggagttcgtgacatctccggcgcggagggactcgatgtctatggcaatggtcgcctggtggaagggacggaactagatcccttcgctcgggacgctcacattccaggcccttgtcctgcaggctgccgcgggcggacacgccagaggaggaggccggggaatggccgcggtgtggcagcaagtcttagcagtggacgcgaggtgaggcgtggggtcaaagcccatgggagcagaacttactgtggtgcatgcgcaatggcgataagtgaggctgggcggagaacttgccttatgcggctgcgtgggcatgccggaggtgagcatgcgcagtagcgggggcgggcacgcccgcggtgagttggctgcgccggagaggattctaaacagcaagctgggaaaatgtggtcagatgtgggcatgcgcaaagcggctacctgtgagagggaggtggggctcaggcaggtgacatcctatcccctatgggtgtcccctagacttttttttttttacatcatcacttccccattctgaccccatcacctcccaacgctgacccccataatgtcagtctgatttctgtcgccctggtatactgaccctaattattgtctgcgctgacccagtcaccccgtagggaccccagcacggcagcagactgactctgttgtctgcaaactgacctcatgaccatgctcattattactgcagactcactcccaccacaggaccaagaggtccctcatcaccactgctagtcattcttaccacctaggccccagtcactgccacacacctcactctcctgccgtacccccccccccgagctgattgattccctctgtcctgtgcctgctgcctgccctgcatcctgaccctgcaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggtgagcttctggccacattcacccccgggcataccctgcctgcacacattcactccactgactttcatcaagcacctgctctttgctgggcactgttctgcatcagcagaggacaaaaagataatatgccaagtaaaccagtaaacacacaaactttgtaaacaggtcagtaaacatatagcaagccctgtctttagtatctgctgagcagggggagggcaggaacagcagaactcgtgaggaagccactgcagtagtacaagtgggcagcggtggtggtggcaggggacacagtgagaagtgatctgactctaggtagattttcagggctccacacctcaaaggttctcgggctttttgcaagatgcacccaccctgaccctctccatttgcaggactttgaggatgatcctcgggccctgggggcccgtgggcaccgtcgttctgtcagcagaggctcctaccagctgcaggcgcagatgaaccgtgccgtctatgaggacaggtatgcaccagaggcagccaaggcggggggcgggttgcgaggaggagaggggccctggggcaatggcagactgaacactctcgcatctacctcctgtcacccctcacttcctattggggcccaggccccctggcagcgtggtgcccacgtcagcagcagaggcaagtcgggccatggccggggacacgtcactgagcgagaactatgcctttgcgggcatgtatcatgtttttgaccagcacgtggatgaggcaggtgagccagtgggtagcgggttccatcaccaagcgtttgcccaaactgtgacaaccaaccaaggcatccttttctgaatccaaggcccctggcacactccaaaggaggaatgaccatccataaagccttttgtagactgaaaatccctctgcaaagtggtcagtgcttcgtctactggaaagggcctcagaagcctaagagagagccctttgcagcaggctgcctgggttcctgagtcacttggaagagttcaaagcctttgctgatgataaatccccttgcagagggcagagtgggctacagtgtcaagggttttgcaaattgccaagaccttgattataaagtgttcgctaagacaggaactttttcatgttgcagaagacttttgcaatctgcaaaggagctgctaagacttagggagctttggcagagggtcttcaggggttacagttccctttgtcagccaaggaaagccctttgctgaggccactgttcctcatgcagtggggccccagccccaggcacacacgtcagagccttttagagagaaaagtgcccagtgagtgtgcagattcccactaatggcttcttggcattgcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtcaggctccaggacacccactcaccaagggctggtgggctgggtcaggaaggctatctgagggaatcagagtataaggagggacagccagggggggcctaggacccccccaccccccacccaatctcgtcagagcagtcctagtgtg[136 bp omitted]cggtgaaaccccatctctactaaaaatacaaaaaattagccgggcatggtggcgggcgcctatagtctcagctacttgggaggctgaggcaggagaatggtgtgaacctgggaggtggagcttgcagtgagccgagatggcaccactgggcgacagagcgagactccgcccccaccccccataaaaaggggaatgccgttcttgatctgggttggccttgctgtggtacactccagggagcacgggccagggtcagggttctggctctggagcccctttggtcccatcagctacagtcctacagttttccaactgcaggggctacctctgaggagcaggatgatgaggctgagcctcgtctggtctgtcagtggccccaccgtgtcagactccagggtagattggtcagagagcaggggaaggacattagaaagtctggtgtggcccggggtgtagtggggtgaactgcagaggaacagaccaagagtgagcttgtgggccgggatcctccccgcattagcagcagccccacaagttccagaaaggagcagccagggagcaggggaaagctgggatcacaggcctaggcaggccctatggttctcacactgtaggaggactggccaaggggcagcatgatggctctgaaggccctttagtcccgtaggcaggtggcctactctgggcagattgcaaaaggggctggctagggaggtggattcatgcctggtcaccttgtctacctgccacagccctattgtgaatagactctaatagggaccagccagtcgcatcaacagcagccccactgtggtcagactcaaggagggcctggctggaagcaggatgatggtctgtgcattctccccacaggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccatggcagtgtcttctctttcctctttgatatggccacaggtaggcagacagcaggcctgcatctgggtgctcgccctccagccctcccagggcacagccctcaccctcacctttgccttccctccctctgctgctgcagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacaggtgggtcccccatcagggcctcctggagacggaggacctgcctcctccagcacactgggacagtagctcatctcctccatcaggttaatttaattgagggagcagtagtagcagtaacagtaatagcagtagtgagcgcgtttacagccatcactgtggccaggccctgttcgaagcagtttccacgtatcaccacattcaatccttgcaccgacctgtgaggtaggtgctgttattatctccattttgcaggtgagcaaactgaagcataaaatagattagggctacttaaagcagagacctgttttcctttcttccttccttcctttttttttttttttttttgcggggagtagtgtgggggttactgtccccactcacatctgtcatgttacccaaatgcagttctcagcctgggccacacattggaatgacctgaagagcttcaaaaactcctgtctgggcccctctacaggccagtaatttcagaagctttgggatgggcctgggcattggtagattgagaaattccctaagcaatgtctggccagtcctgaaaaccactgcctaacaggatgctttttattctacccctttatttctctcctcctttttaaacaatttctgtatatatacttaacaattttttaatttaagcgtacccttaagtttgcccatttcccacagcctctcctttcttcctcctgccacctctggcctcctcctgccacagtaaagcccattaatgatccacatctttccacatatccttctctttccacaaatcctaggcgtgtacatatatccatgtatgtttttgtttgtttgtgagacagggttttgctgttacccagattggagtgcagtggcatgatcatggctcactgcaacctccaactcctgggctcatgcgattctcccacctcagcctaagtagctgagattacaggcacacgccaccatgctcggccaacctttttaatctattttttgtagagatgaggttttgctgtgttactcagtctggtcttaaactcttggcctcaagtgatccttgtaccttggcctcccaaagtgctgggattacagacgtgagccaccttgcctagctcccaccacagttttgaaagaaagacgttttaaagaaatggccttttccggccaggcacagtggcgcactcctgtaatctcagcactttgggaggccaaggcgggtggatcacctgaggtcaggagttcaagaccagcctggccaacatggtgaatccccgtctctactaaaaatacaaaaattagctgggcatggtggcaggcgcctataatcccagctacttgggaggctgaggctggagaattgcttgaacttgggaggcggaggttgcagcgaggcgagatcgtgccattgcactccagcctgggtgacagagccagactccatctcttaaaaaaagaaagaaaaaagaaatggcctttcctacatttcgagtttctcaccaggcaatgccttgtggaaacccccccaggttacctgtggggacagtgttttattctctctaagggctgtgcagttttccacagtgtgggcataccatggtgtgttcatttcctctctttgtgcttatcttaataccaggatcttttagagacccttacaaagaaaaactagtgaatgaaactgcagaggctcccatttatatcaacagagacagtttctgaaccatcagtaactcacacatcagcccctacttatagtttatgtagtcatctcagaattgggtttcataagctgggtgtggtgtgtgcctataggtagtcccggctactcgggagactgaggcgggaggatcacttgagcctaggaggttgaggctgcagtgagccgtgatcgcaccactacactccagcctgggtgacagagtgagatcctgtctcaaaaacaaaaaaaaaaatatgggtttcatgaaccctgtaaagaacttaggcacaggggtggggacacaggcccacaacttgtctccctgctagggctggggctgtgttttgacccactctctcatcctctcagggtggtagacaacgaggggaccctgcagctgaagagaagcttccccatcgagcagagctcacatcctgtgcgcagcatcttctgtcccctcatgtccttccgccagggggcctgcgtgggtgagtcctgtagggacaggggatctgggtggctggggaggggcaggaaccagggctggtgccaacctggctcagacatcacgacaccgatgccctgacttcctggacctcatgacccctcctgccccaacagcctcactgtggaactcacagctccaaacagctcagagaactcacagtttgcacttgatctcggccaaaaggccgagaagtgatgaaaactcacactttgaacgcactaactccccaaacagcccagagacctcgcattctgcacacagtaccaaaacagccaggtgacctcccatctagggatggggccccctcaaacctccccaagccatgctaggacctcacacctcggacatacacccttcaacacctcagacacctcagggacttcccaccaggggcaccccaggcgcctcccgatggcctctccctctcaccccgacagtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacggggttcattgactcatttgtgcattcatgcatcgacggattcattcattccacaagcattgattgaatgtctgctgggttacaggccctgccttaactgttttacacacttatgcattcgatagacattagtgagccctgaccgtgtgccaggaactgttctaggcactggggatactgctctgacctaaactgatggaaatgcctgccttcattgggcttgcatcatagcggagacagtagataaaaacatggaacaggccagctaatgatgagtggtatgaagaaaataaagcaaggatgggagacagagctgcagaagttgggggagtgggctctttatggtgacagcatcagggaagatgatcctgacagggtgacttttttgtttttgagacagggtctcactctgtcacccaggttggaatgcagtggcatgaccatagctcactgcagcctcaacctccagggctcaagtgatcctcacttaagcctcccaagtagctgggactacaggtgtgtgccaccacactcgggtaatttttgtatttttagtagagacggggtctcgccatgttgctcaggctggtcttgaactcctgggctcaagcgatccactcgcctcagcctcccaaagtgctgggattacaggcatgaaccaccacgcctggctcagggtgacatttaaagacctgaatgaagtgagtgggagtcatagtgtagggggagaacattccaggcagagagaaagccagcctaaaggcactgaggctggagcgctccagaaggatcattgtgtatgccagagtcttgctggaccagagtgtgacagtacatgaggtcagacaggccagatgcttcatgggccacagttaggactttggctttttttctgagtgggggtgaccagaaggtgtcaagcagaggaggaacatgatctgacttggtcatagaggctccctctggctgctgaaggggacagattgggggtgggggtagaagcaggggacccagcaggagacccctctgagcgcagtgatggggacttgcaccagggtagtgacagtggaggagttggcgggggaatgttgggtcggacccccagggggttcactatgttaggctgcaggactctgctgcctcctcagggggcgatattcccaacccttctgtgcattgtgttgtttattaaaagcagggagcagaggtgttgagtcctggagccccaagctggtgcaggagcaacgggaagttaaggctgacctggggcctcctgctgtgtggcggaatctccatccctcagaccacccctgtctcctcccagccccatccagggtacaaattccagccctggaacagctcagagaccaaaaagtgatgttaagtatttgaggggagccccaagagaggagaaaaagctttgagtattgatgggggtaaataaccaaaatcacttatcagtggcctgcgtcaccagaaaatgtcaaagttacctgaagcagcaaagaggctcttgctccggcccctcccttccttctcagctccatttgttgccacatatgcgttgactggaactgcgactgacatcttgggaccttagggtcagtccacagcgtggtagagactccagcttggcccagcattgctgagctgctgaactcgcaccaacagtcttgttggagggaaataatctcccgtttgttcagtccagttatttgacagtgtggttacttgcaccccaagcatttctaactggcacttccatctaatagacctcagggtacatggtggtgagatagggacatcagtgagctggattgttcccatggtaaaggtcatgtatgtgtgtgtgtgtcatggtcctcaataccagccccaagcccagtgatttgctaggaggactcccaagactcagtatgtggttgtattcatggctacgattgacttattacaacaaaaagatatggagcaaaatcagcaaaaagaaatggtgtgcaggaccaactcccagagagacccaggcacaagtttccagggcttctctctcattggagtcacacaagatgtgctcggttcacagtaatgggttgtgacaatacatgcgaaatgttgctgaccaaggaagctcaattagagactcagcacccagaggttttttttgttgttgttgttgttttggtttttttttggcgggggggggggggtcttgctctgacgcccaggctggaatgcagtggcatgatcttggctcactgcagcctccacctcctgggttcaagcgatcctcgggcctcagcttcccgaatagctggaactacaggcgcgcaccagcaagctcggctaatttttgtatttttagtagggatggggtttcaccatgttggccaggctgatcttgaactcctgacctcaagtgatcctcccacctcagcctcccaaactgctgggattacaggcgtgagcacctggctggtatcaagtttttattggggcatggtcacataggcaccccctgcctggcacctacccaaatcccaggctcccaaaaggaaagcaggggctcagcataaaccacctttttttttttttttttaattgagacggagtctcgctttgtcgccaggctggagtgcagtggcgtgatctcggcttactgtaacctccgcctcctgggttcaagcaattctcctgcctcagc[134 bp omitted]acctcccaaagtgctgggattacaggcatgagccaccgctcctggcccacttttttatacaaacagcttaggtagagtaagccattcttttttttctttctttctttttttttttttttgagacagggtctcactttgttgcccaggctggagtgcagtggctcaaacatggttcgctgcagcctcaacctcccaggctcaagcggtcctgctgcctcatcctccaaagtagctgggaccacagacatgcaccaccatgaccccagctgatttttgcagagatgggttttgccatgttgcccaggctggccttgaactcctgggctcaagtgatcctctcaccttggcctaccaaagtgctggcgttacaggtgtgagccaccacacccggcccgagtgagccattcttatctcttagggaatggtgggaaccctcctggagtctatgttcttagacaccacccaagggccaaccttgaagcaggcctttccaaggatcgcagttgaggcctgctctgttactgtttttctgcacagtgtgcaacaccacacagatgcccagtttctaccaaggtctgtggatggcaggataattttgaggaacctcctttttcgctaacactttcttcttttgtttacactcttcacattgtctattgagtctggattcaagatgattgattgtgaatattgttgtgcatgattttgggggtttcctccttgtgaaattttgaggtggcagatttgacattctactttaaactcatcttggtggcacttttcttgactcaccacctaagggggaataaataatgaagaaagaataaaaatagtgttatcagtcacatttgggcctcggttaacttgttcagcatcactggtttcacatcagatctgaagctctgtcaatcattccactatcaattccactctggtcttgcctcaaatcgaggcttcgattaactgttccctgccctttgtctgactttgaacctgtgtgtttgtcaactactttaccatcaagagcctctctgggccagg[138 bp omitted]ggtggcacgtgcctgtagtcccagctactcgggaggctaaggtaggagaatcacttgaacccgggaggcggaggttgcagtgagctgagatcgcgccactgcactccagcctgggtgacagagcgagactccgtgtaaaaaaaaaaaaaaaaaaaaaatggctgggctcgatggctcacacctgtaatcccagcactttgggaggccaaggtgggcagatcatgaggtcaggatatcaagaccatcctgtccaacatggtgaaaccccatctctactaaaaatgcaaaaattagctgggtgtggtggcgcgtgcctgtaatcccagctactcgggaggctgaggcatgagaatcacttgaacccagcaggcagaggttgcagtgagccgagatcgcgccactgcactccagcctggcgacagagcgagactaaaaaaaaaaaaaaaaaaaaaaaagcctctctggtctcagaacgaagctgggcctttgttaactattaccccactggtgtaccactggtcaaatctcaaaccagggctactgtataatatttcactagcaattggcttctgatctgaccttgaactgaacttgggtttctattaactactgtattttgtgacggtgcccttttgctccattccaacctcgaggaccctcagtcctgacgttacatctgggcctctgttaattatgtcaccaccaatgcccttatggtgtcaattccagtctgcacttctgtattaacggttgcaccactggctgggcaggcacagtggctcacgtctgtaatcccaacactttgggaggccaagatgggcagatcacctgaggtcgggagttcgagaccagcctgaccaacatggagaagccccatctctactaaaaacacaaaattagccaggcatggtggtgcatgcctgtaatcctagctactcgggaggctgaggcaggagaattgcttgaatccgggaggcgtaggttgcagtgagccaagatcacgccattgcaccccagccctgggcaacaagagcgaaactccgtctcaaaaaaaaccccaaacgacaacatcaccaccaacaacaaaacagttgtaccattaatgcccatggagtctaaacttaagcccaggcctctgttaactagtctactatcactgactctttgg[139 bp omitted]ctgcctcagcctcctgagtagctgggactacaggtgcccaccaccacgcctggctaatttttttgtattttctagtagagacagggggtc[142 bp omitted]cctcaaacccaggcactttatttatttatttatttatttattaagacagagtctcactctgttgcccaggctggagtgcagtggcacgatcttggctcactgcaacctcttgctcctgggttcaagtgattctcctgcctcagcctcccgagtagccaggattacaggtgcccgccgccaagcccggctaatttttgtatttttagtagagatggggtttcaccatgttggccaggctggtctcaaactcctgacctcaagtgatcctcctgcctcggcctcctaaagtgctggaattacaggcatgagccaccacgcccggctgaccttcatttgatattctagcttaaaggtccttctggtctcgaatcaaacctggacctcggttcagttttcatccaacaatgccacatgggtaatgcctggtcttctttttaactattcaaccttcagtctcctctgatctgactttgaatgtaggccattttaactcacaccgtcaattggtctgatctcaaatctggtctactgttaagcatcaatgttcttctggtttgttctcaaaatctgggttctcttttcttttctttttttttttttttcagacggagtctcgctctgttgccagggctggagtgcagtggcatgatctcggctcactgcagcctccgcctcccaggttcaagcaattctcctgcctcagcctcccaagtagctgggactacaggcgcatgccaccacgcccggctaatttttgtacttttagtagagacagggttt[140 bp omitted]atcctggtccctaatcagagctcttccactatccttgctctctagtctgtctgattcttaaccaggacttacatttcctatttcatatttaaagatctactagtctagttagccaacacagccatttaactatccccaaatccttccactccaagccttctcaaaccagtcttctgttaaatacaccaccaactcccatctggtttgaccttgaatctgatcctctgataactgctccatcgccagtgtcctgtggatctgtcattgaacttgtacagttatctcttccaacaccagtgcccctagagtgtgaactcaaactccaggctctgttaagtattctagactcgagtccactctgaactgacctcaaacctagatattcatttgattgtcctcatccctttttctctggtttgatcctaaaccaaggtctgtgttaactattacgcctggaatgttcctctagtctgagttcaagcattttctaactatcccaatatcaaatcccacctctttgtctatatatttaacagaataattaaagcagaactaattaaaactccttgcccctcttacttgacctcaaatctgggtgtctttattctatcatcagtgcttttcttgtctattattgaactctgtgtattaactctcctaacatcaatgtccgtgtctgactttaaacgatggtgtctgttcattcttccactataaattcctctctggtagtgttgccttccacacaggcctctgataaaactaccattgttaatgcccccttaaacaaggactttggttagtgagtttaccatcaataccttcccgtttgatttttttatttttattgagacagagtcttgctcttgtcacccaggctggagtgcagtggcacgatcttggttcactgcaacctctgcctcccaggttcaagcgattttcctgcctcagccttctgagtagctgggattacaggtgcatgccaccacgtgtggctttttttttttttttttttgagatagtctcgctgtgttgcccaggctggagtgcagtggcacgatctcagctcactgcaacctctgcttcctgggttcaagtgattctcctgcctccgcctcccgagtagctggtattacaggcatgcgccaccatgcccagctaacttttgtattttcagtagagacagggtttcgccatgttggccaggctgatctcgaactcctgacctcaagtgatccgcctgcctcagcctcccaaagcgctgggattacaggggtgtgctatcacgcccggctgataccttcctgttttaaagcactgaccctggcatgtgttaactagtccatcacccatgccctattttctgaccttgaacttggaccattgttttgtttttgagacagagtttatttatttttgtgtgtgtgtgacggagtcttgctctgtcgcccaggctggagtgcagcggcgtgatctcaggtcactgcaacctccgcctctgaggctcaagtgattctcctgcctcagcctcccaagtagctgggactacaggtgagcgccaccaggcctagctacttttttgtatttttagtagagacagggtttcaccatg[136 bp omitted]ttacactttaaacctgggcttatggcaaatacttcagcattagtggccttcagatctgaactcaaatatagaagattaaattactggacttataaggacttcagagtggtcactattaaggaaatgcagactgcagtcaggatataatggggtgagagactgcagtgtggacataagtgttcacagaaataaatgtgagttctagtggagtcacagactggcgtatggacactcctgtgatctatacctgacactgtgtgaccccaggagtttctgcaccctgctctgtgtgacaccagaagtagtcatgtcccagtatgtatgtggccaggagtgtccacattctagtctctgtggcctgaggattgttggcatcctggtccctgaacccgtaagttcacactccaatctgtgtgacccataagtgtccaaattcctgtctgtgtgaccccagaagtgttcatatcacagtcgatatgagtatctatacctagtctgtctgaccccagcatttccaaactgcagtctgtgtgactcatggggttcacatcccagtctgttatcccaagtatgcctacacccagcctgtgtgactctcagagcatcgaaacccgtttgtgtgatctcagaagagttcacatcctattcacaaaggagagaatagatattctttcatttctgctgctgataattagagaaatgtaaattcaattgttttttgttttttgttttttttgagatggagtctcgctctatcgccaggctggagtgcagtggtgtgatctcggctcactgcaacctctgcctcccgggttcaagcaattctcctgcctcagcctctcgaataggtgggattacatgcgcccgccaccacgcccagctaatttttgtatttttagtagagacagggtttcaccatgttggccaggatggt[131 bp omitted]aacagggataggttggcgcagcggctcatgcctgtaatcccagcactttgggaggctgaggtgggtagatcacttgaggccaggagtttgagaccagcctggccaacacagtgaaaccttgtctctaccaaaaaaatacaaaaattagccaggcatggtggtgtgtgcctgtaatcccagctactcaggaggctgagacaggagaatcgcttgaacctgggatgcagaggctatggtgagccgagatcgtgccactgcactccagcctgggtaagagtgagactttgtctcagaaaaaaaaaatgacaagggcactcagactgaatgaatgctcccaagaaataaccaaatgatatctgaatcaatatgattcagaaagtttttttaatgatgcataaaaatgcatgagaaaagtaaagagacagagaaaacagcagttgcaatagaaattcaagataaaattagggaaaaaagcattagacagtcaaagaggaccctttttattgatgaagggcatgatcaacattgaaaatacaagtcttgaattcctgtattccatacaagagatcgaatctttagctagaggaatggaagacagccaattgaatcctagccaaacttatgcatatggtcggatcaaattgaggaatcttcacagcagacactaaaaattgaaatgggcctatcaattaggtttagtggacaatggaggaaaagcgaggaagtggacacatggtttacccattttctctccctggacccaagaaaggatactttggtgaccttgggtgttctcccttgcagtgaatataagtggctacagtacaatgttgagcgcccctatgagaccttgacatgactacactaagttcattttcaggtgcttattcaaaggggaagtcactgatggcaaattctacctcacaacctcatctgtatagaaaagatgtgccatgatcgtgccactgcactctagcctgggcaacagagtgagaccttgtctctaaataataataataataaattccaaaacaaaacaaaacaacaacttatagtggccataagctcaagaccacaatgcaatcatggttagaaattagtactcaattgtacagaagaagccattaagcccctcctaccacagctaactgagattccggctggtggctctgaggctttgtcctccatctgtccatggtgatgctctagcatttcataacagggttggtctggtcagctctcaacacatcaacataacttactcttgcatccgagagattattcaagtgccaagtaccatcactttcttcttcttctttttttttttccttgagacaaaatcttgctctgtcacccaggctggagtgtagtggcgccatctgggctcactgcaacctctgcttcccgggctcaagttattctcatgcctcagcctcccgagtagctgggaccacagatgcatgccatcacgcccagctaatttttgtatttttagtagagacaggttttccacattggccaggctggtctcgaactcctggcctcaagtgatccacccaccctggcctcccaaagtgctgggattacaggtgtgagccaccacacctggccactatcaactcttcattgttgagtttttctaagttaaaacaacctgttttttgagctatgctgcatattacatgtttcaggaactccccatagactgatttcccagctccagaaacatgcaatccatctgctattcccttgggctttttgctttcttctttattttagagatgggggagggtctcactatgttgcccaggctggacttggcctcctgggctcaagagatcttcccacccctgcctctcaagtagctgggactacaggtgtgagccactgtgcctagctttttgatatcttgattccctcagaaccaggtggaaacatgttctgaataaaagccagtcctgggtattcttgctctactcaccggcttggttgtgttgggctgagccttatagaacacagtgctggagaccttctcagggtcacttcctgtacccttgactttgagctgcagccctctggttttctcaggtgagttttcttgactctttccactactcttcagccgataaagtgaccattccactcatgtgctttcccctggggtaactcctagtggatgcagtgttgggaccccttagtttcactgggcagtgtcacagggcaggctctttagaagcagaatttcagctggagtttggggcacaggaggtttatcagttgatgtaaagggaaggaggaggaagcaggatcgggcagggggagagctgagtatgatgcaagccacacaaagccttggccagcccagcggggagctctggagcagggatggcgtggcagagtgttttggggtaaagggcatgagcttggggaagtgactttctgcagactctgatggagctgacatctggaggctgcctgcccaccgcactccctgcagctgtgcagcgagcctttccttgaaaaggggtctcagtggtgcacatttttttttgagacagagtcttgctctgtcgctcaggctggagtatagtggcatgatctctgctcattgcaacctctgcctcccgggttcaagcgattctcacgcctcagccacccaagtagctgagattacaggcgtgcaccaccacacgtctctactgtttttagtagagacggggtttcagcatgttgaccaggctggtctcgaactcccgatctcaagtgatccgcccgcctcggcctcccaaagtgctgggattccaggtgtgagccaccgcacccagccagtggttcacatctttgtctcccactgtcaggaaaggtatggggaggagctgtgaaaagaaatgggtggccactgggtaagtaactggggacccagggaaaatcctgttactcccatgactcgcccacatggtcctgagccagtcactttaccactctgtgcctcagtttcctcaagactcagttgagggttggggagtatatccattcattcttctgacctatattgactgagtacctacatgtgccaggcactgtgccaagttataacagtcaacaaggcacacaaaacctcgccctcagggagctgacattgccaagaacccctcaaatctacccagtgacccagactgagggcagatgtcacccctggccttgcttgcaatgatcatgacgcacagtgagcaccgtggcctcgttgcatattcagacagatgacagcctgacatggaagctgaggatctaatcagtggcatccacatggtaacaggaaggaaggagccactgtgggtccttgagcaggagcacggagatatcagtgcaaaacttcagaagggcaattccagtggcaatcaatagaaaaagacctttttactgcatgtcaccctgccccttaggtgagtcaaattaaggcaaatagccgaggccaggccaccctgtctgtcccctgttatatttttggttttggtttgtttatagctgagttattccctagtggtggcagtgatgattgggaatttggctttctgatctgaccatttggtgacttctgggaatgaatgaacggatgttggcagagaacagcaggagtcaggcatgttatcctgtgtctcttggatctcttgccctgtggctaacggtgtgaaaatgaagcattaagctccctctgtggctgcagtcagactcctggggtgagtgagtaatgttttcccatctctggagggtgtctatacattattttgtaatgtcacttgaattaaaggaactcagttctgattggctgatagagataaataagcacttatacaaatcaaatattcctaaaatttaggaaaatgaggaaatcagactttttaaatggctgtcctctgtagtccaggaagaaactgaacttttagtaccgtaaatgcactagtcttgaaaaagattcctccttcagaaactaattcagagactttaagaatccaagttctcataattaagataaatctttggcaaatgacattagtttaattatttgagtttaataaaaacagtataggatgggtgcagtggcttatgcctgtagtcccagcactttgggaggccaacgtgggagaatcccttgagcctgggagtttaagaccaacctggccaacatggcaaaaccctgtctctaccaaaaatacaaaaattcgccagtagtggtggtgtgcgcctgtagtcccagctacttgggaggctgaggtgggaggatggtttgagcctgggaggcagaggttgcagtgagctgagatcatgccattgcactccagctggggtgacagagccagatcctgtctcaaaaaaagcaaaaacaaaaacaaaaacaaaattatgctattattaagtaattatcctgtaattattatggatgctttctctctgatttgttagtgttaagtataatacaagtgtgcatttatctacttaagtttgtattttcctaaattgatgaaggtttactgatcaaataagctaccacttctcctccataatgttgaagattacaaaaaatgtatccttgcatttgactaaaataaatcattaatctaataagtttatttcaacgtaattatgttttgtagtacgtcatcttgaagataacttccaagatctttaggtaattgaaaattctgactgatactcaattgacttaattaatggatgttcactggatgcccagagcatttctaagtaaggaagaaaacggaaacactgattactaagcacaattttaaatttgtataattttgcttattattatttttaaatttaattcaatttattttaattgagacagggtcttacttcgttgccctggctggaatgcagtggtgcgaacacagctcattgtggccttgacctcccaggctcaagcgattctcccacctgagcctcccaagtagttgggactactggcgcatgccaccaagcccggctagttttcgctttttgttttttgagacagggtctcactctggttgcccaggctggagtgcagtggcctgatcttggctcactgcagcctcgaactctcaagcttaggtgattctcccacctcagcctcccgagtagctgggacaacaggcacacaccaccacacccagctaatttgtgttttttgttgttgttgttattgttgttgtttgagatggagtctcactctgtctcccaggctagagtgcagtggcgtgatctcagctcactgcaagctctgtctcccgggttcacaccattctcctgcctcagcctcccgagtatttgggactacaggtgcctgccaccatgcccagctaattttttgttgttgttgttgttgttgtatttttagtagagatggggttt[141 bp omitted]gttgcccaggcaggtctcgaactcctgaactcaagcagtcttctcgcctcggccacctgaagtgctgggattacaggcctgagccactgcacccagccatatttttgtattttttgtagagatggggtttcgccatgttgcccaggctggtctggaactcccaagctcaagcaattcacctgcctcggcctcctgaagtgctgggattacaggcgtgggccactgtgcctggcctgctgcttgtttgtatgtgctacagagaggccctgttttggggtctatcaatcaacatatccatttttgccacatcaagatgtcatataagggatgtgggccattctagggagctggtttaagtgtagccctgagcttggctagttgactaaaatgacatttcacaattatccacaccttggtgaagtcaaagttagttctatttaatctcttagggcttattaaagaccccaaagagctttgatttacgtgggttatggctattgatacttactgggttagaaattaaaacagaaaattgtaaatatttattgagtcatagtaataacaaatgcattaacatgtttaacataaagaatatcttagggccgggtgcagtggctcatgcctgtaatcccagtactttgggaggctgaggtgggaggatcacttgaggctgtagtcagactcctcaggtgagtgagcaatattttcctgtttctggagggtatccataaattattttatgaagtcacttaaattaaaggaactctgttctgattggctgatagaaataaataagcacatatacaaatcaaatatttctaaaattataggaaaattagaaaatcaaactttttttttatttcctgggcaacatagagagaccttgtctctacttttaatttttatttaaaagtaaaaaatgttgggtgtgatggtgcatacctgtagtcccaactatgtgggaggctgagatgggaggattgcttgagcccaggagtttgaggccatagtgagctatgatggttgctactacactcaagcctggaagacagagcaagaccctgtctcataaaacaaaacaaaacaaaaacatatcttggtattactatgaaatcagttctgacctttgggcccttgacatctgtcttcaagtaaagtgtcagtttgttccatgatatgaaacttggaaagtgaatgttatttgccttggctgataacccctgagttatggaggaagctatgcaatgtattcatgtcttaggtttgtttccttggcttacaacatacatggtgattcttttttttttgtgagacggagtctcgcttctctgtcgtccaggctggagtgcagtggtgcaatcccggctcactgcaacctctgccccctgggttcaagcgattctcctgcatcagcctcccgagtagctgggactacaggcacgcgccaccatgcccggctaatttttgtatttttagtagagatggagtttcaccatgttggccaggctggtctccatctcctgacctcgtgatccgcatgcctcggcctcccaaagttctgggattacaggcgtgagccaccgcgcccagcctgttattctttactttatatttaatctgcctagagaggaaagaatgttttactagaatagttttctgtgctttattttggctttagtatgtccttaatttttttggggggggcggggcgcagcgcggacagaatcttgctctgtcacccaggctggcgtgcagtggtgcccatcttggctcattgccacctctgcctctcgggttcaagcaattctcctgcctccgcctcccgagtagctgggattacaggtgcgtgcaaccatgcctggctaatttttgtatttttaatagagatgggatttcaccagttgcccaggctggtctcgaactcctgggctcaagtgatcaccccgcttggcctcccaaagtgctgggattacagatgtgaggcaccgtgcctagccaattttttttttttttttggagatggagtctcgctctgttgcccaggctggagtgcagtggcgcaatctcagctcactgcaacctccgcctcctaggttcaagtgattctcctgcctcagcctcccaagtagctgggattacaggcacacaccaccaggcccggctaatttttgtattttttttagtagaggtggggttttaccat[140 bp omitted]ttttgttttgagacagagtcttgctctgtcacccaggctggaatgcagtggtgcgatctcggctcactgcaacctctgcctcctgggttcaagcaattctcctgccgcagcttcctgagtagctgggactacaggtgcctgccaccatgcccggctaattttttgtatttttaatagagatggggttt[132 bp omitted]acaaagaaaaaaattttctctcttaagtgatttataatcatgttactctctatccgtatttttatgttttattgtcactttggtcaccattattgtttctcaggtacctataatatcttactcaagtgtataaaactcctcttaatttttcttttttcctttttttttttttgagatggagtctcgctcttgtcgcccaggctggagtgcaatggtgtgacctcagctcactgcaacccctgcctcctgggttcaagcgattctcctgcctcagcctcccaagtagctgggattacaggtgtgagccaccatgcccagctaatttttgtatttttagcagagacggggttttaccatg[138 bp omitted]actggagtgcaatggcatgatctcggctcactgcaaccttcacttcctgggctcaagcaattctcccacctc[134 bp omitted]cagcctcccaaagtgctgggattacaggtgtgagccaccttgcctggccaagccaccatgcctggcttaggttttcatttttatcttcccaaagtcagacctaaatatagaaaaaaataaagtttaactttcatgatctcctttgtacctaaaactatctttgagatttcacacagggatcctagaaagttacaaggatcagttatttcactttatttaaaaaggatgctagataccgggtgtggtggctcatgtctgtaaacactttgggaggctgaggcaggcagatcacatgaagctaggagttctcgccaacatagtgaaactctgtctctactaaaaatacaaaaattaggctgggcgtggtggctcatgcctgtaatcccagcactttgggagtgagtccgaggcaggcggatcacctgaggtcaggagtttgagaccagcctggccaacatggtgaaactccgtctctactgaaaacacgaaaattagctgggcgtggtggtgtgtgcctgtagtcctagctccttgggaggcagaggtgagagaattgcttgaacctgggagatggaggctgcagtgagctgagatcatgccattgcactccaacctgggtgatagagtgagactccgtctcaaaaaaaaaaaaaaaaaaattaggccgggcatggtggctcatgcctgtaatcccagcactttgggaggccaaggcgggcagatcgcttgaggttagaagttcgagaccaacctgggcaacatggggaaaccccatttctactaaaaatacaaaaattattggtggcgggcgcctataatcccagctactcgggagactgaggcaggagaatctcttgaacccaggaggcagaggttgcagtgagccaagatcacgtcactgcactccagcctcggtgacagagtgagactctgtctcaaaaaaagaaaacaaacaaacaaacaaacaaaaaaagtgtatgctttatcggaagttcctggagatgtgtgcccttgcttttcataatatgttgcaacttagaggaaacactgaatgaaactgttatgaaatatttcctgggcagggcggtggctcatgcctgtaatcccagcactttgggaggccaaggcaggaggatcacttgagcccaggagttcaatacaagcctgggcaacacagtgagaccccgtctctactaaaaatttttttttaaaaagtaaacgggcatggtggcatgcacctatactctcagttactcaggatgctgaggtgggaggactgcttgagcctcgtaggtcatggctgcagtgagctgagattgtgccatggccacagagcaagaccctgtctcaaaaaaaagaaaaaaattattttcgttgagttttcctgtattcatcagagtcctggtggtgctttgcttgatgatattagacaacagcagtatagagtattattggtcataataattggttattattgtaaatgcttacttgctcacagccttctttaatttgaatctgacatcttctaggccagtgacgctcagtgcacatcagacttacccataaggttttattaaaatacagatgtttagattctactccaaactgactgaatctcgttattttatattcttggtatattatgcatgctacatctcaggattattatatactatatacaaatttttttttctatatactatatacaagtttttttttctggttggacgtggtggctgatgcctgtaatcccaacactttgggaggccaaggtgggcaatgacttgagcccatgagttcgagaccagcctgggcaacatggcaaaacccagtctctacaaaatagtacaaaaaattacctgggcatggtggcatgtgcctgtaatctcagctactggggaggctgaggtgggagagttgcttgagtccatgaggtcaagactgcagtaagctgtgattataccactgcactcaagcctgggcaacagggcaaaaccctgtctctaaaaaaaaaaaaaaaaagtaaaaataaagattttttcctctataagaatgtgttcatccatatttataaatgagaggtagcattcacaggtgtctttgaaaataaactttggccaggtgcagtggctcattacctataatcccagcactttgggaggctgaggcaggtggatcacctgaggtcaggagttgaagaccagcctggccaacatggtgaaaccctgtctctactaaaagtacaaaaattagctgggcgtggtggcgggtgcctgtagtcccagctacttgggagcctgaggcacaagaatcactcgaaccagagaggtagggttgcagtgggccgagagcgtgccactgcactccagcctgggagacagagtgagattctgtatcaaaaaaaaaaaaaaaaaaaaaaaaaaaacggcggggcatggcggctcatgcctgtaatcccagcactttaggaggctgaggcaggtggatcacttgaggtcaggagttcaagaccagcctggccaacatggcgaaaccccatctctaataaaaatacaaaaacattagccgggcctggtggcacgcacctgtagtcccagctactcgggaggctgagggagagaattccttgaacctgggaggcagaggttacagtgagccgagatcgtgctactgcactccagcctgggtggtagagcaagactccatctcaaaaaataaataaataaaaataaacttaatcattatctttagagacatttttgtctaaaaaaattattaggaacggcttaaaactgcaaacatttttatcttagtttctgtaggtgtgggatctgggtgcagctttgctattactaatagatagtcctggctcagggtctctcatgaagttgcgtctagggctacagtcatctgaaggcttgactggggctgggggtgtctgctcccaagaaggcccactcacctggctgatggctggtgttggctattggctggggtgcttcaggtctcctccatgtggcctctcagtctccagggcctcatttttttcatatagcctttctaattgatggctgggctccagtgagacagagagagggatctttttataaatgaatctcagaggtggtattatcatttctaccatattctatttgttttgagtcacaaaatccagaccacactcaaggcggggggcacagacaccaggatggggaatcatcagggaccacctcaaaggctgaccacagcattgcccctaaaatgtatggggccccagacaagtattttttgcaggaactctgtctatataaacaatttaaatacaaaatgtattacaagatcatgagtccatatgaggtattgggatttactgatgaagattttaatttatttattttagagatggggtcttgctctgtcacgcaagctggaatgcagtggcgtgatctcacctcactgcagcctcaaattcctgggctcaaatgatcttcccaccttggcctccagagtagctggaattataggcatgacgccactatgctcagctaattaaaaatttttgttgttgttggtggagatagtgtcttgcttttggagggtaaaggtttagaacaatgtgtcgacccattgtgaagtgaaataaatcaatcaataaataaaatagaacagtgtgtatgtctgggtgtggtgactcacccaactacttgggaggctgaggtggagcccagggttgagaaatgttcaaggctgcagtgagccatgatggcaccactgcacttcagcctgtctctaaaaagaaaaatttttaaatgaaataatgctatagctgtcataaatttgtaggtactaattaatagagtggcaagatgcaaaaagtataacctctgggaaatgtaataaataaatgatggaaatataccagaagcaggaggctttaacttacctttgtcagcaaatgacagctctagtagacaaaaacaaaaacagtataattaataaagctatatcaaattctcttttcttaaaaccatgaatacatcttttagtcagtcagcaactatggaacattagtaatcactggccataatattaggccacagagaaaagtttaataaattccaaaaagtagaatggatacagaccacattctttgaccataatgcaataaacataaacatggactttttcttttttctttccctttcttttttttttcttttcttttttttttgagacagagtcttgctctgtcacccaggctagagggcagtggtgtgatcatggttcactgcagcctctgcctcttgggctcaagtgattctcctacctcagcctcctgagtagctgggactacaggcgtgagccaccacacccagctaactttttgtatttttttgtagagacggagttttgccatgttgcccaggctggtcttgaactcctgagctcaagcaatcctcctgcttcggcctctcaaagtactgggattacaggtgtgagccaccaggtctggccaaacttggattttttaaaacaaaaataaaaccacaaaactccaatagctcagggaaaaaagatttagctctctcacgttttataatatccagtgctgtcaagagtatgaggaaaactgataatatataacaggtggcagtataaaattcagcaagcattttagaaaaagtttcacagtatttatcaaagttttacatttatatacattttgatccaggattttttttttttttggctaggaatttgctctttgtgtgtgtggtttttttttttgttttgtttttactttgtaaatttacttaaaaaaatagctgtctgcatatttttaatggatgagtaaaccaaaaatatataaacagctatttataaaggggtgaataaaaaaagataaaatagtttcttatgggtggagggagagggaagaaggttgaggagacagggatagaagctagatttatctaaatataccatattattattattattattattattttgagacggagtctcactgtgtcgcccaggctggagtgcagtggcacgatctcggctcactgcaacctccgccacccgggttcacgccattctcctgcctc[222 bp omitted]tattgagaaccatgcaaacacagtatcattgtataatcattattatataaaattatgtattatttaaaaattgcatcatatcaaaaggaagttatagattactggggtcatatcaagcaagtttcaaaggctcccattggccaaagatggggcaatttgagcatcaaaaagaacaataactgcaatagattgaaatacatcacctagccctcagggcagaatgatgccacaaaatctccctggccacctttggaggatgctagtgaaccaactcattctgaaaactgataaataaagagagagacaaagtaactgactagataattgattaaagaattattatttttgagatatgatcatgatttactgctaacttgttaaaagctcttatcatttgggccgggcgcggtggctcacgcccgtaatcccagcactttgggaggctgaggcgggcggatcacaaggtcaagagatggagaccatcctggccaacatggtgtaaccccgactctactaaaaatacaaaaattagctgggcgtggtggtgtgcacctgtagtcccagctactcgggaggctgaagcaggagaattgcttgaacctgggagacggaggttgcagtgagccgagattgcaccactgcactccagcctggcaacagagcaagactctgtctcaaaaaaaaaaaacaaaaaaaggaaaagttcttatcatttacagcaacatcttgagagattcatgggtaaaatgatgtaatatctgggtgttgcttcaaaataatccagtggggatgtgggtagaggacataaaagaaacaacattggctgtgaattgataaatgttgaactaggtgatgactacatggagatttattgtattgttctctctacttttttatacgcttgaaattttccataacagaaaaataattttatggaggcaaaagctgtaaacagtgttctatgcctatattgagagtatgactcatgacttttttttaaaaaaagccagacctgaccttaaaaatttcttttattttaatttaattaaaaaaaatttttttagagacagcgtctcactttgtcgcccagactggagtgcactggtgtgctcatagctcattgtgcagctttgaactcctgggctcaagcgatccttccaccttagcttcttgagtagctgagactacaggcacgaaccaccacacccaactaatgtctttatattttatattattttattataattttattttactgtattttatttatttgtttgttttgagacagggtctttgctctgtcacccacgctggagtgcagtggcatgatctcagctcactggagccttgacttcctgggctcaagtgatcctcccacctcagtctcccaagtagctgggactacaggcatgcaccaccacacctggctaatttttaaaaaattttggtagcaatgggacctcaacatgttgcccaggctggtctcaaactcctggactcaagcaatcctccctcctcagcttcccaaaatgttgggattagaggcattgaaccactgcacctggcctattttatttttgaaaatagagacaggtggggggggtgggtgtctccctatattgctcaggctggtcccgaactcctggtctcaagtgatccttttggcttcccaaagtgctgggattacatgagccaccactcctggccactgtgctgggtttaattgtggagaactataactaagcattgtctttaaaaaacgagtacattggccggg[138 bp omitted]ggtggcgggcacctgtagtcccagctactcgggaggctgaggcaggagaatggcgtgaacccaggaggcggagcttgcagtgagccgagatcgcaccactgcactccagcctgggcgacagagtgagactgcctcaaaaaaaaaaaaaaaaaaaaaagagtacattttgggccggttgcagtggctcacatctacaatcccagtactttgggaggccgaggcaggcggatcacctgaagtcagaagttggagaccagcctgggcaacacggcaaaaccccgtctctactaaaaaaacataaaaactagccaggcatgttggcgggcgtctgtaatcccagctactcgggaggctaaggcaggaaaattccttgaacctgggaggtggaggttgcagtgagcccggatcacgccactgcactccagcctgggagacagagggagactccatctcaaaaaaaaattaaaattaaattaaaataaaaaaagaacattttggcctacaattcctgacaaagatggaatgtgggcaaatgcatgatgacctggattatttctgggagaattgtaaagagtttctgtagtcagcagaaatgctttgaatactttccatatattagttcattaatcccccatgaagtacaagtaggggaaactgaggcacagggaagttgactaatttgcccagggtcacaaagtgagtaagtggcagaaccgctatttgaacctagctgcgctcatagtgctttaatcttcaatcagcgaggatcgtcaagttggctgctggatctttctggatctttttttcattacctcgcctttcatgttgtttgtccacatagcttgaggctttatcacagattgctcttgggggcagtgttactccagaaatgccggaatgctccgctattcctcactccacccctaaatatacagcatctcctcccgcccttaagctctgaaaaaaatgctgcggagccagaaaggctgcagaaagccgggtgtgaccactggctctgtagccaacctgttccctgctgctgctgctgctgctgctgctgctgctgctgcagtcgtttggtttcctctttgaatctgagatgattctgaggtctacactgcaaactcttggcatatatcatttctagaattccattcctactcgacctaggctgtgagtctgcactagttcgcggcacgttagatcgcgcccatttcccttattggcaagttgtcaggttgaggaagctccaggcctggaggagggcatctccagccaccagccatgaagcccagggcctcaggcaccttctggcctccgggtggcctcctctattcgctgacccagacactagtccagtggttcccaaagtggggttccctggcaggcagcagctgcctcgctgggaatctattaaaaatgcatactcccaggccccacccatgacccactgaatcagaagctgtgggcctggggcccagcagttggtgttttcagaagccctccagtggactccaatggttcctagagtttcaaaagcacactgggctaggccaggtgtgccaagagagaagtagctttttggctcaagtcctcacaggaatggtcagagggtccccatcagtctatcagtgtgcaccatacaacgctcacagagggacacacgtgtgcccgtgtgcatgcgtccctgtatggactccagttggagggggagggacagttttgccttgtggttttgtcactcgccattggaaaatagccctttcccctactactaaatagcttcccattgttttctagtccctttacttccatttcagagagtgttttctcttctgtgtttttttgtttgtttgttttttgagacggagtctcactctctcacccaggctggagtgcagtggcgcgatcctggcccattgcaacctccgcctccgggattcaagcaattctcctgcctcagcctgctaagtagctgggattacaagtgcctgctaccacactcacctaattttgtatttttaatagagataggggttttgccatgttggccaggttggtctcgaactcctgacctcagatgatccacctgcctcgacctcccaagtgctgggattacaggcatgagccaccatgctgggtccctcttctctttggaaaagtcatccacgttggttgcaagtttttcagaaaagagggaactacattatagaaataaatggcaaacagacacccaacacccaaggaataatttctcatctctgtcctttcaatgtgtatatttctaaatgtccgtgtttatatttacataaattaaaaaaaacggtttacttgtacgtgtcattttgtttttatcttaaatttttgtgtttttaattttggtgatatatcattttggttgtactttttcacttctgtacatactgttacataacatgcagttttccagtaacactaacttgtgaatgcatattttacaattttatttatatttatttatttatttacttttgagacagtctcactctgtctcccaggctggagtgcagtggcttgatctcggctccctgcaacctccacctcccaggttcaagcaattctcctgccttagcttcccgggtagctgggattacagacccgccaccgcgcctggctaatttttgtttttttaagtagagacggggttttaccat[140 bp omitted]ccaggctggagtacaatgatgcgatctcagctcaccacaacctccgcgtcccgggttccaacgattctcctgcctcagcctccccagtagctgggattacaggcatgcaccaccacacccggctaattttgtattttcggtagagacggggtttctccatgttggtcaggctgatctcaaactcccaacctcaggtgatccgctcacctccacctcccaaattgctgggattacaggcatgagccaccgtgcctggcaggatagaagccattttaactggggtgagatggtatctcattgtagttttgatttgcatttctctgatgatcagtgacattgagcaccttttcctatgcctgcttgtcatttgtaggtcttcttttgagaaatgtctattgagatcttttgcccactttttgatcagattattagattttttcctctagggttgtttgagctctttatatattctggttattagtcccttgtcagatgggtagtttgcgaatattttctcccattctttgggttgtctcttcactttgtggattgtttcctttgctgtgcagaagttttttaacttgatgtgatcccatttgtccatttttgctttggttgcctgtgtttgccaaattcattttacaaggccagcattaccctaatgccaaagtcagacactacaagaacactacagccaatatccctgatgaacataaatgcaaaaagcctgcacgaaatactaacaaacaaaatccaacagcacattaaaaggatcatacatcatgaccaaatgggattaatccctaagatgcaaggatgggtcaacatacataaattaataaatgtgatataccacattaacagaatgaaggataacaatcatctcaaaagattcagaaagagtatttcacaaaaattcaatgccacttcatgataaaaactctaaactaggtatagatggaatttacctaagcataataaaggccatatatgcctggctaatttttgtatttttaatagagacggggattcaccacgttggccaggctggtcttgatctcctgacctcaaatgatcctcacctcggcctcccaaagtgttgggattacaggcgtgagccaccgcaccctgccacaattttcttctaagataaaaaagtttacataagggttctctgggatggaaacaaaagttggacagagccaggattattttaataaaatacaattaataggagttgtgataaatgaaatgatgccccacaaaagtgcccatgtcttaacccccacgttctaggaatatattatggtatatgacaaagaatagaggctgtagataaaatcaaggatgataatcagatgactctaaaacaaagagattaatttgaattatgagattggtgtctacagccataccaccctgaatgcacctgatcttatctgaattataagtgtgagcctagggtaatcacaaaagttcttaaatgggaatgagaggctaagaaaattaatgctgtgatatgagagtcagatttttttttaatttttttttaaattatgttgggctgggcacagtggctcacgcctataatcccagaactttgggaggccaaggcgggcggatcacctgaggtcaggagttcgagacaagcctggccaacatggtgaaaccccatctctactaaaaatataaaaattagccaggcatggtggcaggtgcctgtaatcccagattcttgggaggctgaggtaagggaattgcttgaacctatgaggcagaggttacagtgagccgagatcacaccattgcactccagcctgggggacaagagtaaa[139 bp omitted]acggtgaaaccttgtctctactaaaaatacaaaaattagccaggcatggtggtgcacacctttagtcccagctactagggaggttgaggtaagagaattgcttgaatccgggaggtggaggttgcagtgagccgagatcatgccactgcactccagcctgggcgacagagagactccatctcaaaaaaagaaaaaaaaaatatatatatatacacacacacacacacacaattattcttagaatatatatatatatatatatatacatatatatatatatatatactaggtatatagtgtaaaaataatgctgactgtacttttgaaaatttatgtaatagaattaatcaagaattttatgagataaaaaagtgatgattttgaacatacaataaataacatttatgaggtaaagtctattttttttttttgagacagagtcttgctctgttgcccaggctggagtgcagtggcgcgatcttggctcactgcaagctccacctcccgggttcatgccattctcctgcctcagcctcccaagtaactgggactacaggtgcctgccaccacgcccagctaattttttgtgtttttagtagagatgaggtttcacc[138 bp omitted]tttgcaatttacattattacattccacttatgttttcattgaaaaatgcctctttttttcaagctggcattggaatcttgaccctcagcttcctcattttcttcctcgtcttcacacttcttctgtaatgcaggcctgagcccacagacctgaccatttatcacctggtcttcatccacatagtgatcctccttactctggtgtcattgttgtctccaggtctgcctgagtcactgtattttcagaatgacttcaagtgtaaaggattttttttacctgaacaagatgatgagaagtttctccatctgcaccacctgcttcctgagtgtgcttcagaccataatcatcagccccagaagctcttggttggtgaggtttaaccataaatccaccattttcacctgtcatttcttgttgtttttacattttctcagtttttttttttttcagtagtaatctcatcttgtgcactgtggggtcttctaatgtgaccctgagcaatcttctgcataccagtaaagactgttcacttttccaccatgaactccatcatcagaagactgtttcttactctgtttcttactccagatatgtttttcttataggaacaatgctgctttcaagtgcatacagagtggtccttttgttcaggcaccagaagaaattctgatactttcacagcaccagcctctccccaagaccttccccagagaaaagtgccactcagaccatcctgctgctagtgagtttctttgtggtcatctactgggtcgatttcatcatctcatgcacctcaacctcgctatgggcatatgaccctgttgtcctgggtgtccagaggcttgtcagtcttttggtgctactcagatctgataaaaggataatcattgtgacacaaactgtgagacagagggttaacaagttatttttattgaaaatagattattctgtcaccagttaaattacataagtagtacagaacttgctatttaatttaacttaaatgtatggatttacactttcaatatgtctaaatacttttgaatcaaatgctgccaattctctgtgggttttttttagtttaacatacatgatggatagatactcccatatgtttacaagtgtcttctttttcattttgattttcaggccttaatacagagaacatttttctttctttttgaagtataatattaagaatatcctcctggtaatataatctctctgtcttcgtatttttgagaatgttttatttttatttattaaagatatttgactaaatattaaattcttacactcaatatttacttctccttgttctggcttctatcaaggctgtgtggatggtgcctacaaatttgtggcttacctctgttttttatctccctaattttaagatttttctttctttttagtgttatacagcttgactattatttctgtataaatgatcacctgtatttaccttttttttgaaaactatgtacttctgaattcgagaattttttctggcttttaattttacaaaaaattatttctttctaaaattacatttgtgtcttattctttgtatgtatttcagtgaaacaactgaatatactttattccttctaatctttgtctttatagatctataaatatatttacatcttatatcactttacttttattagcatcgattttctctccttaatcttccagtgcactatttatctcattagcttattctaagttaatagtttcccaatacaatgtatattgaatttatagatttttatttctcatttattcaatttacagttagctctttccatggatgctcttcaatttttaagtttcttcctctttaaacactatttttgtctcttattttatcactgaattgatgtaaacattttaaatacaattccaattattattaatttatgtagcatccaatttcttcttactctaaattgtggtagcttattttgtgtgtgtgtgtacttcataacttcttataatttagctgtcatgattgggagacctttccctgtaaatgtcttcaatcagtatatttgtttgttctacttaacctggcacaatattatcaattttgccttgtgatcagccattcgcttctcacgttgataaagcctttgaatcttttcttgactcatttgtgttcctggaaagttctgatatttttcctttcagccccattgggcattctagagatttttgtaacttttgatgcacaaactttcacactgcacacataaaatattttagttatgtaatgctaccacacatcagcatcttatgagaaatcttgagtctctttacttgaagcaccccctctccaatatacagtatgatacactgatgtgcagaatgtgattagtttattaatcatatgtgaaaatattagtagctacatatggccagaatagatttttctctctacaaatgtaagttagtgttgatagaatttgttatgcgatatttggttctttggtttcagtctcaatgctttcttcttggcatttcattgactctgtaaattaacctcagcatcaattttcttttaaattcaacagttattcaaattgatcgaaaattaaacttgtatgtagctagttatcacttgtgggttacactttaattgacggtttctgatgtcatttcatagtgtctagaatataggacctattggagatctactttcatgaaattactgacataattttgggtccaaaatttcaaaattttaaatatttttatttggaattttaaaataatttatatgctctttttactggctaataatgctattcattataatctgatattcaaactgtctaaaaaagttaacaatcattgatttatttgttgtatatacagtttatttctatgacagttttaatgtcacctaatattatttttaatgtttcaatttctcatttaaatacattttgtgttgtttattttaatctcattcaatctgtatgtgcaaatggcttagaaaaaaaggccatatatgacaagcccacagctaacatcatatagtcaacagtgaaaaactaaaagcttctcctttaagatcaggaacaaggcaaggatgcccattctcaccactcctattcaacatagtactagaagtcctagccagagcaattaggcacgaaaaagaaataaaaggcagctgggcgcggtggctcacacctgtaatcccagcactttgggaggccaaggcaggcggatcacgatgtcaggagatcgagaccatcctggctaacatggtgaaaccctgactctactaaaaatacaaaagattagccgggcgtggtggcgggagcctgtagtcccagctactcgggaggctggggcgggagaatggcgtgaacccaggaggcggagcttgcagtgagccgagatcatgccactgcactccagcctgggtgactccagactccatctcaataaataaataaataaataaataaaaaagaaaaaaaaagaaataaaaggcaacaggccaagtgcagtggctcacgcctataatcccagcactttgggaggctgaggc[131 bp omitted]tgaggtgagagaattgcttgaacccgggaggcagagggtgcaactccagcctgggcaacagagcgagacttcatctcctaaataaataaataaataaataaataaataaatggcaaccaaatcagaaagaaaaaaaactacctgtttacagatgatagaatcttatatctagaaaactctaaacactccacaaaataactgtgagaactaataaacaaattcagtaaagttgcaggatacaaaatcaacattaaaaaatcagttgtgccgggcacggtggctcacacctgtaatcccagcactttgggagacagaggtgggtggatcacctgaggtcaggagctcgagaccagcctggaccatatggcgaaaccccgtctctactaaaaatataaaatattagctgggcttggtgctgagtgcctgtaatcccagctcctcaggaggctgagccaggagaatcgcttgaacccgggaggtggaggttgcagtgagccgagattgcaccattgcactccagcctgggcaacaagagtgaaactctgtctcgaaaaaaaaagtcagttgcatttctatacactaacaatgaactatctggaagggaaattaagaaaataattccatttacaatagcatcaaaaagaataaaatacttaggaataaatttaaccagacgtgaaagacatgtacactgaaaactatgtaacattaattaaagaaattgaagacaataccaatgaacagaaagacatcctgggcttgtggattgttagacttaatatagttaaaacgtctatactacccaaagcagtctacagattcaatgcaatccctgtcaaaatctcaatgacattttctacagaaatagaaaaaaatccaaaaatccatatggaactacaaaaggcctcacagccaaaacaatcttgagaaagaagaacaaaagagtcatcacactttctgatttcaaaatctattacaaggcttcagtaattaaaacagtatgctactggcataaaaacagacagacatagaaaccaatgaaacagaatcaagagcccagaaataaacctcacatatatggccaactaatctttgacaaaggtgctctgaatacacaagaggaaaaggataatctcttcaacaaatggtataggaaaaatttgatatccacatgcaaaataatgaaatggacccttatcttacactacacacaaaaataatttggaatttattttaattattccattattttaataaagaaatttatttttaaataaatgtaaataaatacattttattttattttattatttatttatttttttgagacagattctcactctgtcgcctaggctggaatgcaatggcgtgatcccggctcactgcaacctctgcctcccaggttcaagcgattctcctgcctcagcctcccgagtagctgggattacaggcatgcgccaccacgcctggctaattttttgtatttttagtagagacagggtttctccatgttggtcaggctggtctcgaactaccgaccttaggtaatcctcccacctcggcctccgaaagtgctgggattacaggcgtgagccactgcgcccggcctacatttatttttaaataaatggatttaaatgttaagacctgaacctataaaaatgggacacctgcatagggcattaaccatgagtagagcttgcaggactggaagttgctatgggtgagtcagtgtgtgagtggtgagtgaatgggaaggcctaggacattcctgtacactaccatggactttataaattctgtacacttaggctacactacatttatttaaaatatttttcttttttgggccaggtgaggtggctcacgcctgtaatcccagcgctttgggaggccgaggcaggcggatcacctgaggtcaggagttcgagaccagcctgaccaacatggagaatccctgtctctactaaaaatacaaaattagctgagtgaggtgacacatacctgtaatcccaactacttgggaggctgaggcaggagagtcgcttgaacctaggaggcagaggttgtggtgagctgagatcacaccattgcactccagcctgggcaacaagagtgaaacttcgtttcaaaaaaaaaaaaattcttcctattttttttttttttttttttgagacagaatctcactctgtctcccaggctggagtgaggtggcacgatctgggctcactgcaaccttcgcctccagggttcaagcgattctcctgcctcag[132 bp omitted]cggcctcccaaagcgctgggattacaggtgtgagccactgcacccggctcatttaaaatatttttcttggctgactctgggcacactacctatgagttagccctgcttctcaaggagcagtaccattcaaaaaattaaaattaaaaaaagagagaaaaagaaatttaaaaaattttctttcttcgataataaattaacctttgtttactgtaactttatggactttttagtttttaaaaaacttttttactcttttgtaataacacttggtctaaaattaaagacattgtatagttgtacaaaaatattttctttctttatatccttattgtataagttttttctatttttaaaaatattttacatattgcttgagcccaggagtttgagaccagcctgggcaacatggtgaaaccccatccctacaaaaaattcgctgggcatggtggtgcacacctgtagtcccagctactagggagactgaggtgggaggactgcttgagccggggagattgaggctacagtgagctgagattgcaccactgcactccagcctgggtgaaagagtgataccctgtcttcactctctctctctctctctctctctctctctctctctatatatatatatatatatatatagctatatatctagtatatatatatgctatatataggtatgctatatatagtatatatgctatatagaggcatgctatatatagtatatatatgctatatagagatatgctatatatagtatatatatgctatatatagtatatatatgctatatagagatatgctatatatatagtatatatatgctatagagagataaatatatatatactatatatatattttaacattttgaactttttagttaaaactgagacaaacacacacgttagcctaggcctacacagggtcaggatcatcaacatcactgtcttccacctctgtatcttttcccactggaaggtcttcaggagcaatgacaggcatggagctgtcatctcctgtaacaatgccttcttctagaatgttttctgaagatctgcctaagggtgttttacagttaacctttttgtgtacataagagtacactctaaaataatgattaaaactatggcatagtaaacacataaaccagtaacagttgtttattatcatcaaatattatgtactatacataactgtatatgtgattcagtatttttattttattttattctattctattctactcttattttattattttattggaaacaaggtctcactctatcgacagactggagtgcagtggcccaatcctagctcactgaagcctcaatctcctgggctcaagtgatcctcccacctcagcctcctgagttgctgggattacagatgcctgccaccgtgcctcgctacagtacttttataggactggcagcacagaaggtttacaccagcatcaccacaaacacgtgagtaatgtgttgtgctatggttagatgataggaattttttttttttgagacagagtctcactctgttgcccaggctagagtgcagtggtgcaatcttggctcaccgcaacctctgcctcctgggttcaagcgattctccctgcctcagcctcctgagtagctgggattaaaggcatgtgccaccacagtcgggtaatttttgtatttttagtagagatggggtttcgctatgttggccaggctggttttgaactcctgacctcaagtcatccacccaccttggcctcccaaagtgctgggattataggcgtgagcctataatctggccagatgataggaatttttcaactgtattataatcttatgggacaactgtcatatatgtggtctgtcattgacagaaacatcatcacttgttgtatgactatggcatgattccacttatatggggtatccagagtagtcaaactcatagaaacaaaacactaggatggtggttgccaggggctgagaggatggggaaatggggagttgctgttcaatggatattgcgcccggccagccacaccaattcttacaccaagaagtgatggagcacaagtgctgatgggccttaacaccatcataaacatcttttgtttgtcccggggaagaaattcccaactccttccaaaggtctgccaaagtctaccagtatcccaagctgatttccttatcccctcagcagatgctggaaagctggaagtctccttccttctcactctcctgcttgacatctgcacagccattcttcttcctccccttgctccccttcctccccttctccttctcctacttattgagacagagtctcgctctgtcgccgaggctggagtgcagtggtgtcatctcggctcactgcaacctctgcctcctgggttcaagcaattctcttgcctc[134 bp omitted]tggcctcccaaagtgccgggattacaggcatgagccaccggcgcccggccctttttattattatatattatttttgagactgggtctcactctgtaatccaggctggagggcagtggcgtgatcacagctcactgcagccctgacctcttgggcacaagcagtcctcccgcgtcagccacccaaagtgctgggtctacaggcatgagctactgtgcccagtctacgatttttttaaaatttataattattttgtttattcaggcagtacaacatgatgttttgatttatgtacacattatagagagtcaagctaattaacacacccaatacctcaccaatttatcatttttgtgtggtgagaacgttaaaaatccattctttctcctctgaagctgtagaggatggggtgtccctgctttcctttttaacgataaaatcatgtttgttatttcataaaatagttagacagtgaggctttgttagtttgtttaatgtcctaactcggcaaaattgaaaggtggcaacactctgcccctctcccatgcaccatgcatacacacatatgtttacagctaggttttttttggggggggaggtagtatccatatcatgtattaattttcttacaatttattttttcttttctttcagtgacggggtgttgctctgtcacccaggctggcgtgcagtggtgtgatcatagctcactacagccttgacctcccggcctccagctatcctcccatctcaggctcccaagtagctgggaatacagacatgcaccaccacacccagctaatttttctttttctttttcttttttcgtaaagacaggatttcgccatgttcgccaggctggtctcgaactcctagcctcaagccatcctcccaacttggcctccaaaagtgctgggattataggcaatgagccaccatgccctgcctaattttcttacaatttcaaaatataaatatcatatcttaataatttataatgacgtcaccaatattctccctattgtctcaaaaaagtggcaacctttgcagaagggaggatcttctaaaagaacaaaatgaaaaaagataagaattctaacttgggtcttgcgccgggcattgcctgaagcagacagccagaggcaatctttcaggaatggagtgaggaagaaatggggagggagaggtaagcctgggggttctgtgggcagcaggaatcttcagctgctgggaggtaaggggacttctaagaaagtggatgtcctctgtttgactttgttatattttctgctgtgtggcccgggcttgtcagcttgtcatctttctcccttggccctataaacacagagaaacagagaaaagaacaagaattctggggacagtggaattagaaccagaggtgaccaaagggacatattatccaggtggtaactgccggaagtagatgttctttaacagtttaaaaagtgatgatgaggccaggcacagtagctcgcgcctctaaccccagcactttgggaggccgaggtgggtggatcacctgaggtcaggagttcaagaccagcctggccagcatggtgaaaccctgtctctactaaaaatacaaaaaattagccaggcatggtggcatgtgcctgtaattccagctacttggaaggctgaggcaggagaatcacttgaacctgggaggcagaggttgcagtgagccgagatcgcaccactgcactccagcctgggcaacagagtgagactccgtctcaagaaaaaaaaagtgatgatgatgatgacagaaagaatacaatgtagaaaagcttagacccttggctaatggggctttgtttaaccacataggatttaatcccaaccacttctgccaaaattttgttctctagaggccctattctttgctttctttattattattattattattattattatattattttttttagagttgaggagtctggttctgtcacccaggctggagtgcagtggtgtgatcttggctcactgcaacctctgcctcccaggttcaagcaattctcctgcctcagcctcctgagtagctgagattacaggcgtgtgccaccacgactggctgatttttgtatatttatttatttatttatttattttctgagaccgagtcttgctttgttgtccaggctggagtgcagtggtgcgatcttggctcactgcaacctctgcctcccaggttcaagcaattctcctgcctcagcctcccaagtagctgggattacaggcacccaccaccgtgcctggctaatttttgtatttttagtagagacggggttttaccatgttggccaggctggtcttgaactcctgacctcaggtgatccacccacctc[132 bp omitted]ccccattcttttgctttctaccctttcttaaccctgttcccaaaatgtatgcgtctgtggctggaatatgttaaagggaagtagctttccacctctgtattggttcattctgactctgctttttcttgcacctgtgctcttctttttaaaatgtttttgagtgtttttatttaacactaatacacattgggtttggccaaatagatgtcttttcatccctgtgcccctctgcaatgatacatttctggagaggagaggccaggcaggtttcattatccttacacattacctggcaagctgccatgtgcaacaggtatttaatacatattttttgaaaaacaatctctcatgtctttggaatcattgggaactacaaccaagtgaaggcagtagaagttggtggctgatgaagtgcctacaatgcatgctatttctatagggaagattccaaacgtacgtcaattgttagtaaaggaattgatagaggccaggcatggtggctcatgcctgtaatcccagcactttgggaggccggggcaggcgaattgcttgagcccaggggttcaagatgtagcctgggcaacattgtgagattccgtctctactaaaaatacaaaaattagccacatgtggtggctcacacctgtagtctcagctacttgggaggctgaagtggaaggatcgcctgattccaggagttcaagaccacgctgggcaacatagggagacctcgtcactaccaaaaataaaaaaaattatctgggcgtggtggctcatgcctgtggtcccagctacttaggaggctgaggtgggaggattgcctgagccaaggaggtcgaggctgcagtgagctgagatcatgccactgcactccagcctgggtgacagaatgaaagcctgtcccccaaaaaataaaataatgaaatcatgagctaaaccaagtacaaaattaataaataaaaagattaaaaataaaaataaaataaaggaatggatagaagggatgaattgtcaacaagatcccgatatgttttcccttctgatttcaagtatctaattcagttattcattttaccctgagggtggcagcaggagtctcttctatcgcccaagcgttgccaagaggcaacttttaggtcactctgacatgagctaacagatgcagtttctggttagagagcttggacagatccatgccatttcctctcccttacaaggttggggggaaaggctgcgtgcggcctcaggaaaccctggggagcagcagggatcctccccagctgtcgcccaattagaaagccagtgatttaacagaaggccaagaagactcacagggccaggcctggggttctctttgttccaccttttttcccatgctgagaaatgaaagagaaaaacattgcatgacaagaattaatggtgtcaaacaaatagcatcaaagacaatttaagtattgctcttctctctcggaaatggatgaagacaaagagtagtggcttcctttttacccattaactgctctacatttggaaagagctggtggacagtgttttcatactgtatccattcagcttgatgcttacaaatgtacagttcagaaatttttcaaggaaacagtttgctacaaagcacatagtttcctctgatcataaccatgacctcgtttataatcataatcttgtttataatctcaggatgccaacatgcccaaaatgactttggaatcattgttttaaaatttcatctttttttaagactttattttttagagcagttttaggttcatggcaaaattgagcagaaagtgcagaaatttcccagataactcctgcccctacacacccacaacctctgtcactatcaccacccctaaccagagctgtacagttgttgcaattgatgaacctgcaattgacgcatcatcatcacccaaagtccatagtttacattatgactcactcgtgttgtatattttatgggttttgacaaagatacaaggacacatatccatcattgcagtatcatgcagagtagtttcactgccctaaaaatcctctgtgctccacttattcatctctccttcccctcaactcctgtaaaccactaatctttttactgcctccttagttttgccttttccggaatgtcatatagttggaatcatacagtatgtagccttttcagattggcttctttcacttagtatatcagtctgttctcatgctgcttataaagacatacccaagactgggtaatttataaagaggtttaacggagtcacagttccacgtggctggggaggcctcacaataatggtggaaggtaaaaggcatgttttacatggtggcagataaaagagaatgtggaccaagcaaaagggttttccccttatgaaaccatcagattttgtgagacttattcactaccatgagaacaatatgagggaaactgccccccatgattcagttatctcccactgggtctctcccacaacgcgtgggaattatgggagctataattcaagatgagatttgggtggggacacagccaaacctatcacttagtaatatgcatttaagtttcctccatttttttttttttttctgagacagagtctcgctctgtcacccaggctggagtgcagtggcgcgatctcggctctctgcaacctccgcctcccgggttcaagtgattctcctgcctcagcttcctgagtagctgggattacaggcgtgtgccaccacgcccagctcatttttagtagagatggggtttcaccatgttggccaggctggtctcaaactcctgacctcaagtgatccacctgcctccgcttcccaaagtgctaggattacaggcatgagccaccgcgcctggcctcttccatgtctttttatggcttggtagctcagttctttttctcactgcataatattccactatctggatgtaccagtttatttatccactcacctaccaaaggacattttggttgcttccatgtttttgcaattatgaataaagctgctataaacattcctgtgtgtagatttacgtggggacataagttttcaagtcatttgggtaaatatcaaggaatgcaattactggatggtatagtaagagtatgtttagttttgtaagaagccgccaaactgtcttccaaagtggctgtgccattttgcattctcatgaatgagagtttctgttgctccacatcctcgacagcatttggtgttgtcagtgtgttgttttcaccattctaataggtgtgtagtggcatctcactgttgttttattttattttttatttttttaattttgagacagggtttcactctcgttgcccaggctggagtgcaatggcgcgatcttgactcaccgcaacttccgcctcccaggttcaagcaattctcctgcctcagcctccctagtagctgggattacaggcatgtgccaccacgcccagctaattttgtatttttagtagagacggggtttctccatgttggtcaggctggtcttgaactcctgacctcaggtgatccgcccgccttggtctcccaaagtgctgggatgacaggcatgagccactgcgcccagcctaactgttgttttaatttgcaagtctctaatgacatatgatgttgggcatcttcatatgcttatttgccatctgtccaccttctttggtgaggtgtctattcaggtcttttgcccattttttaatcaggttgttcattttcttaccgttgagttttaagagctctttgcaattttggataatagtcatttatcagacacctcttttgcaaatattgtggcttgtcatttcattcacgtttgtggggaggggggaacggagtctcactctgtcacccaggctggagtgcagtggtgcaatctcggctcactgcaacctctgcctcctgggttcaagcaattctcctgcctcaacctccaagtagctgggattacaggtgcacactaccacacctggctatcatctcattctcttgatcatccttttttcttaaattaaaaagtgagcaatttctttgcagtcagaacaacatttctgttggcagtgtgtggtggtaaagagggggactctggagttagcttggatttgaattccagttctgccacttattagctgtgccagttactgaatgtctctgtgctgcactttcctcatctttaaaatgggtatatgagctgggcgtggtggctcatgcctgtaatcccagcactctgagaggcagaggtgggtggattgcttgaggtcaggagttcaagaccagcctgggcaacacggcaaaatcccgtctctacaaaaaatacaaaaattagctgagtgtggtggtgcacacctgtagtctcagctacttgggggactgaggtgggaagatcgcttgggcccaggaggaggaggctgcagtgagtggagatcgtgccattgcactccagcctgggcgagagagtgagactctgtctccaaattaaataaaacaagatggagataaacccgtactcatagggttgctgtgaaaattaggtcaattaatataattagtataagagatttaaaacagtttctgcaatatttattattaaattatttgattagaacaaaagatatagtttgcacagtggcagagacatgcatgaaaagcaatggtagacatttctgacatgaagggcatgccttggcagccttttaagatcattctccactgagcagcagcagtttcgttttagaagtcacatcaaagctactttggcttttgcaaggcgatttctgtgcattatgcacagaatgacataccaacctaagaaaattgatctactagcaattagtgagatggagcaggagaaggagctagcttgctatggaaaaagtgacaaagagatggactgagttgagacacttagaggtctctgacactaactggctgcctcactttgtacaaatcactttattcatctgtttcaggcttccacttggttttgttttgttttttgagataagagtcttgctctgtcatccaggctggagtgcaatggcgtgatctcggctcactgcaatctctgcctcctgggttcaaacgattctcctgcctcagcctcctgagtagctggaattacaggcatgcaccaccaggcccagctaattttttttttttttttagtagagatggggtttcaccatgtt[131 bp omitted]tcagggctggggatggatatgcacattaatcgtgttttttaattttctgtatttcatgatgctttgacatcttggggccttgctaatcttggagagactgtccctcccagggctaactaattcctacagaacttgactctgagcatgcttttgatatgcaaaccaacaatcatgagaccatacccaaaccacctcctttttctaactctcacacaccagccaatattccccctccagggccaggtactgaacaactaggggccaccctgtagcccaccaaaatcattcaaactatccagtcctaaggtttctcagcttgccaatcctgtctcatccattccttcccataaaacctacaataaaggctctgggcccatgctttctcctcactcctgactcctgactgaccctggtgcctcccatgtggcccttgcatggccatggcttggcaagccccctcctcttgagaactgtgagtaacaaactatcttttcaatggcagttgccttgtgatctgctgggctcaccatacctcaatttttaaagattcttggttatattttaaaacaatctaaccccaggtgctaactctggtggctgcttaatagctgtcccaagtgagggatgagaaaaatcttcaggttgagtcaaaatatcaatgtctgccctgagcatgggttgtgaggaataaagatgtgagagaaagggtttgtcctccctgacacagatgatctctaggggcccttgcagctctaatatctaagcattttagaaagtattttaaggccaggcacagtagctcatgcctataatcccagcaccttgggaggctgaggtgggcagatcacttgaggtcgggagttcgagaccagcctgggcaacatggcaaaacccccatctctactaaaaatacaaaaattagccaggcatggtgccacatgcctgtaatcccagctactcgggtggctgaggcaggagaatctcttgaacccaggaggtggaggctgcagtgaactgagatcacaccactgcactccagcctgggcaacaaagcaagactctgtctcaaaaaaaaaaaaaaaagaaagaaaggaagaagaggaacaggagggaggaggagggatctgagctagcacgctcagccccttgccaagtgataccctgcactgtctcaggactcttcagagtcctcaccagcaaaaagtcccccaccagatgcagccccttgaccttagacttctcagcccccacaactgtaagaaagaaattcatttcctttaaaattacccagtttcaggtattctgttataagcaacagaaactggactaagacaggaaaacacaaacattcagtccattgccttccaacacctgcctgcccccgacaattcatgtgcttctcacatgcaaactacattcaattccatccaaacatccccccaaatcttaactcattccagtatgaactctaaagtctaaagccaaaagtctcatctaaagatcatctaaatcaggtatgggtgaaactcaccctgaagcaaaattcctcttcagctgcttaaaagaaaccaaagtatttgcttccaaaatacaatgatgggacacaaagagggtctataaacattcccattccaaaagggagaaacagggaaggaggacggggtgacaagtcccaagcaagtccaaaacctagcaagggaagttctgtgagatcttgagactcaggtaatcctctttggcttgaagctttgcctccagacctactggggtgtcagtccctcatgccagacccactgagggggcaatgtcaccctcacagtgagagacaggactagctggatttcctaggctgactaagaatccctaagcctaggtgggaaggtgaccgcaatccacctttaaacacggggcttgcaacttagctcacacccgaccaatcagggagtaaagagagctcactaaaatgctaattaggcaaaaacaggaggtaaagaaatagctaatcatctatcacctgagagcacagcgggagggacaatgatagggatataaacccaggcattcgagcccgcaacggctaccctctttgggtctcctccctttgtatgggagctctgttttcactctattaaatcttgcagctgcactctcttctggtccgtgtttgttacggctcgagctgagctttcacttgcagtccaccactgctgtttgccgccgtcgcagacccgccattgacttccatccctccagatccggcagggtgtccgctgtgctcctgatccagcaagccgtccactgctgctcccgatcgggctaaaggcttgccattgttcctgcatggctaagtgcctgtgtttgtcctaatcgagctgaacactagtcactgggttccacggttctcttccgtgacccacggcttttaatagagctataacactcacgcatggcccaagactccattccttggaatccgtgaggccaagaaccccaggtcagagaacccgaggcttgccaccatcttggaagcagcccaccaccatcttgggagctctggaagcaaggacccccaccccccggcccggtaacaacagtttggcagcactcactgctcatgctgtggttgtcagggcaggagttgtagcctcagggctctgctgggagcctccatccccaccgctctactgggcattggtctcaccctttgaaatggaggtggaggctgggagtggtggctcacacctgtaatcccagcactttgggaggcc[134 bp omitted]gaggtgggagaatggcatgaacctggga[139 bp omitted]tctgatgggactggtgacctggacggtctctgaatcaccttcagggttcttcttcccttatcttgaagaacagtgtgtgttcacagccgaatagttctatggtttggtcctataggatctaagaagtttaatcatcttccttcattttgtcccattttctttttttctttttcttttttttttttgagacagagtctccctctgttgcccagcacccaggctggagtgcagtggtgcaatctcagctcactgcaacctccgcctcctgggttcaagtgattctcctgcctcagcctcccaagtagctgggattacaggcgtgcaccaccgcacccggctaatttttgtattttcagtagagacagggtttcaccatgttggtgaggctggtcttgaactcctgatctcaggtgatccacccgcctcagcatcccaaagtgttgggattacaggcatgagccactgtgcccagccattttgtcccattttctctgtttcctttagtcccagtcagcagtgccatttccagtacaatcccatcgctattgctgttttgttgagatggttaatgaagtccacagttcacattcacagtaatctccttgtcaaatagtccagcagatccttagtgttctcttccaaacatgctttgtcatgttttgtaatatggacagggacaggctgagaattttccagacccactgagggagcaatgtcaccctcatagcttgggtaagtttaagttctggttcctttttgcataacaattctgttttcaattcatatctctcttctcaaatttgactataagcagtcaggaggaaccaagcctctcctttcaacactttgcttagagatctcctcagctaaatctccatttcactgttcacaagtcctaccctctacaaaacactaaaacgtaaacacaattcagccaggttctttgctactttataacaaggatcaccttttctccactgtccaataacacgttcctcatttctacctgagaccacatcagaacagcctttaaccacccatatttctaccaccaatctgttcatgattacttatgtattctttaagaaagcagaagctttctctacagctctcctcatttctttctgactgctcatcagaatcacctttaaaggtccattcaatggcaatataggatttttctttttttcctttttcttttttttagatggagtcttgctctgttgcccaggctggagtgcagtggcgcaatcttggctcactgcaacctccacctccctggttcaagcaattctcctgcctcagcctcctgagtagctgagattacaggtgtgcgccaccacgcccggctaatttttttttttttttttgtatttttagtggagatggggttt[131 bp omitted]ccaaatttatgtcttagtctgttttctgttgctataacagaataccacagaccaggtaatttataaagaaaagaagctcagccaggtgcagtggctcacacctataatcccagcactttgggaggccaaggtgggtggatcacttgaggtcaggagtttgagaccagcctgactaacatggtgaaacaccatctctactaaaaatacaaaaattagctgggcctggtgatgaatgcgtgtaatcccagctagtcgggaggctgaggcaggagtattgcttgaacctgggaggcagaggttgcagtgagcagagatcgtgccactgcactccagcctgggtgacagagtgagattctgtctcaaaaaaataaaaaataaaaataattttaaaaagaagcttaacaagctcacagttctggaggctgggaagtctaagagcatggtgctagcatcagatgaggccttcatgctgcatcatcccatcatgggtagacagaatggcaagagggtgcatgcgagagacagctcacttttataacaaagccactcccacaataacagcattagtccattcatgaaggtgacagccccatgacctaatgtcttcttaaagaccccacctctcaatactgttacaatggcaattaaaggtcaacatgagttttggagggaacattcaaaccatggcactcttccagcctctagtcattacaattacaaggccacttccacatttttaggtattcgttacatagcacccctcacttctcagtaccaatttctgtcttagtcagttctgactggtataacaaagtgccatagactgggtggcttataaacaacagaaatttctctcttaacagttctggttggaagtctgacattacggttccagcatggtcaggttctggtagggatgctgtttagggttgctgacagctaaattttcattgtatcctcacattgtggaaagaactctctggggtcccttttatttatttatttatgtatttatatttttctgagacagagtctcactctgtcgtccaggctggactgcagtggcaccatctccattcactgcaacctccgcctcctgggttcaagcgattctcctgcctcagcctcctgagtagctgggattacaggcaaacaccactatgcccagctaatttttgtatttttagtagagacagggtttcgccatgttggccaggctggtcttgaacttctggcctcaggtgatccacctgcttcggcctcccacagtgctgggattacaggcgtgtgccactgcgcccagcctggggtccctttcataagggcaccaatcccattcatgagggctccactgtcatgacttaatcacctcccaaaggtcccaccttctaatactatcacattaggggttaggatatcaacatgtttggggagacacaaacattcagtctattgcacagccttttaccttctgcaaataaaactgcttccagtatacccaaagctgtactaaaacctctttttttttttttttttttctggttttcctaggcagagtatttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttggggggtaaggtcacagatcaacaggatcccaaggcagaagaatttttcttagtacagaacaaaatgaaaagtctcccatgtctacttctttctacacagacacagcaaccatccgatttctcaatcttttccccacctttcccccttttctattccacaaaaccgccattgtcatcatggcccgttctcaatgagctgttgggtacacctcccagacggggtggtggccgggcagaggggctcctcacttcccagtaggggcggccgggcagaggcgcccctcacctcccggacggggcggctggccgggcggggggctgactcccccacctccctcccggacggggcggctggccgggcggggggctgacccccacacctccctcccggacggggcggctggccgggcggggggctgacccccccacctccttcccggccacctccctcccggatggggcggctggccgggcagaggggctcctcacttcccagtaggggcggccgggcagaggcgcccctcacctcccggacagggcggctggccgggcggggggctgaccccccacctccctcccggacgggacggctggccgggcggggggctgaccccccacctccctcccggacgggacggctggccgggcggggggctgacccccccacctccctcccggacggggtggctgccgggcggagacgctcctcacttcccagacggggtggctgccgggcggagaggctcctcacttctcagactgggcggctgccgggcggaggggctcctcacttctcagacggggcggttgccaggcggagggtctcctcaattctcagacggggcggccggacagagacgctcctcacctcccagacggggtcgtggccgggccgaggcgctcctcacatcccagacagggcggcggggaagaggcgctccccccatctcagacaatgggcggccgggcagagacgctcctcacttcctagatgggatggcggccgggaagaggcgctcctcacttcctaggtgggaaggcggccgggcagagacgctcctcactttccagactgggcagccaggcggagaggctcctcacatcccagacgatgggcggccaggcagagacgctcctcacttcccagacggggtggcggccgggcagaggctggaatctcggcactttggggggccaaggcaggcggctgggaggtggaggttgtagcgagccgagatcacgccactgcactccagcctgggcaccattgagcactgagttaacgagactccatctgcaatcccggcacctcgggaggccgaggctgacggatcactcgcggttaggagctggagaccagcccggccaacacagcgaaaccccgtctccaccaaaaaaatacgaaaaccagtcaggcgtggcggcgcgcgcctgcaatcgcaggcactgggcaggctgaggcaggagaatcaggcagggaggttgcagtgagccgagatggcagcagcacagtccagcttcggctcgacatgagagggagaccgtggaaagagagggagaccgagagggagagggagactgagagggagagggagaccgagagggagagggagaccgagagggagagggagagggagaccgagagggagagggagagggagaccgagagggagagggagagggagagggagagggagagggagagggagaggaaacctctttctttagcactattcatgttctcttctcctggacgtcagtaccttaaatagagtcatcctccctcatggactccacacttctctctctctctctctgtctctctctctctctctctgagatagggtctcactctgtcacccaggctggaatgcagtggcaagatcatgggtcactgaaacctccacctcccagggctcaagtgatcttctcacctcagcctcctgagtagctgggactacaggcatgtgccacagtgcctggttaatttttgtattttttgcagagatggggtttcactatgttgcccaggttgatctcaaattcctgggctcaagcaatcttcctacctcggcctcccaaagtactgggattataggcatgagccactgtgcctagccatatatccttctctctcttatcctactccagtctggctttggtccgcacttgttcactgacattcctctctgtgacatgatgagttctctgtgggcacactgagtttgaggtgtcaaagcacataaaaatggaaaggtctactaggcagttgtttatgtggtccaactctcttttggttcatatttgcttggtgtatctttttccatccctctattttcaacctttctttgtggttttattctaagcgtgtttcctgtcacaggtctgtagttgaattaacaacaacaacaacaaatccaatctgataacctctgttttcaacaggcatgtaatcatttatatttattttgattacttatgtattggaacttatttctaccatcttatgtttgctgtttactaccccgttccccctcatcttttcccattatatgttagatggataaagtttttgaaattgccccattacacattttattttttcctttgctggttctgaagttatagatggtatttctcctcatttagtggtttccattaatttttaaagttcctgaatctcatgcttccagtatcaacatgcctaaccagcagggcctccattaatttttaaatatatgttctaaattataaatttaagagccaggcacagtggctcacacctgtaatcccagtgactttgaaggctgagttgggaggatcgtttgaggccaggagtttaagatcaaactgggtaacatagagagatcccatctatacaaaatttttttttcaatgagccaggtgtggtggcacatgcctgtagtcctaactacttgggaggttgaggtgggaggatcccttgagcccaggaatttgaggctatagtgagctaggattgcagcactgcactccagcctggataacagagtgaaacaaataaaaaataaatacttatgtttctataaatttacatacatagataaatattaaaaatatattaagccagctatagtggcacacacctgtagtcccagctacttgggaggctaagctggcaggatttcttgagcccaggatttcgaggccagcctaggcaacataatgagaccccatttctttaaaaaaaaaaatatatatatatatatataaatatatatacacacataaacacacaaaccaatatcca[133 bp omitted]aaccccgtctctactaaatataaaaaaaattagccaagcatggtggtgggcgcctgtagtcccagctacttaggaggctgaggca[347 bp omitted]gaggcaggagaatggcatgaacctgggaggtggagcttgcagtaagccaagatttcgccactgcactccagcctcagtgacagagcaagagtccgtttcaaaaaaaaaaaaaaagaataaagacacagtgaatcaagttctttaaaagcagagccaagaagagtcctgtgataggcagcttctgacatggccccaatgatttctgccttctgatatttacacccatgtggaaatccctgcacttgagtgtgggctgaacctagtgaccagcttctaatgaacagaatatggcaaaagtgataggatgtaggatgtcacttctatgattaggctccaaaagattgtgacttctgatgtgctagttctctctctctgtcactatctcttgccctcttctttgctccctctgatgaagccagctgccacagtgtgagctgccctatggagaggcctctatagcaagaaagtgaggccttcagtccagcaaccctcaagcaactgaaacctgccaacaaccacatgagtcagcttggaagtggatccattacccatcaggctttcagatgagaccacagccccggctgccaccttgattccaacttcatgagagatccagagacagagaacctagctaatctgtgactagattcctgactcacagaaactatgagataataaatgtctgttgttttaagctgctaaattctaggtaatttgttacacatcaatacatggctaatacaaagattttttttttctgtgacaactttttttatcatatggagaggcaaaggtggcacagactctacaatcagccaaacgtggctgtctcttgccttgggcaggttatgtaatccctgagctcagtcttctcacttgtaaatcttttttgttttcttccccttcctccctccctccctccttccttcttttttttttttctttttttttcttgacagagtcttgctctgttgcccaggctggagtgcagtggcatgatctcggttcactgtaacctccacttcccaggctcaagcgattctcatgtctcagcctcccaagtaactgggactataggcatgtgccaccacgcctggctaatttttgtatttttagtagagatgaggttttgccatattggccaggctgatctcgaactcctggcctcaagtgatccacccacctcggcctcccgaagtgctgggattataggcctcacttgtaaatctaagctaacaatgcctgccttgcatatgagcttttcagattgttaataaggtttaagagggcatggcacacagtaggtcatcatctttatgacctccattcttgtaaatctgatgctcattccaatttcagtgttctgggttcttcaaaaagtccccaccactaaaactttgctttatcatgaagatttcactcagtccattgtgtgatagtattcataaagcacctgaaagtactacctctcaaatgagtatctcccgttctcaaaatcaatgccacacatagactctaattcaaccatggtacaggggatggtgaattaggcctggagcctctaagcaatggcctgccatccaacatcaaatcatgctgaaaatcctttttttttatactaagacaaaaacacaatcaaagaatcattgcagtttctatgtgaatgaacctcatatgaaatcctctgaacagcagtggctcatatctgagagggaaggaggatgtgagaacatctacattactagatcttcatgaatgggctgctgaagtctggcttttccctgtactaaatctctctgtaattttgtgcctgctcatggaaactgcattcacaaatagtatattatgcatatacacagacttacacagacaacctttgcagataaaaagcaaatccctgccaatgataaacaaaatgaacataaaacctattacagtcttagattatcttctaaaccttacattctcttatgcttaattcttttcatttttaattttaatttttaatttttttattttcctgttctcctcagctgctcataatttgtatttttagagacagggtcttgtgctatcacccaggagtgtagtgacctgatcatggctcattgcagcctcgacctcctgggctcagtgatcctcctacctcagcttcctgagtaactgggattaacatgcccggctaatttttgtatttttagtggagatggggttttgccatgttggccaggctggtctcgaactcctggcctcaagtgatctgccagcctcggcctcctaaagtgctgggattacaagtgtgagccaccgtgccaggcctatgtttattatgtatatatttttacatttaatatgcataccttttcttatattcttgtatttcatacacataatggtcagcagcctgtatatactaccctggatcttttttttttttttttttgagatggagtttcacccttgttgcccaggctggagtgcaatggcacggtctcagctcactgcaacctccacctcctgggttcaagcgattctctggctggcattacaagtgtgagccaccacatccagccttaccctaggtattttagaacaattacagacagtaaatacctatcaatctatacctatatctacatatcttaagaattttattaaaaatgatcaaaagggaattctctcctttttccttctaattcagatctcgagttgcactgttgaagcaatgtgccaaaattgcttttattttcctaaattaaaagatgtgatattatctattcttatcagcaaagggtaaaaaaacaatttattacagaagaaaaagcgagataaaaacataggatggtaggctgggcgtggtggctcatgcctgcaatcccagcactttgggagtcagaggcaggcggatcacctgaggtcaggagttcgagaccagcctggccaacatggtgaaaccccgtctctattaaaaatacaaaaattagccgggcatgatggcaggtgcctgtaatcccagctactcgggaggctgaggcaggagaaacacttgaacccgggaggcggaggttgcagtgagctgagatcatgtcactgcactccagcctgggtgacagagcaagactccatctaaaaacaaaacaaaacaaaacaaaaacaaacaaccaaaaaaatagaatagtccttttcctttcaggattgcaaagagaacataaagaattaagcggcatactttcctaaaatcctgaaacagaaacctttcatcaaagttctaattctactccctctagacggtcatcctcccagctcacccagctggctgcccagtcagtgactaagagcagagctgttttggctcaggctgaagttaatctgtgccttgggcagagacaaactgttggtgcctgtaagagtaaaatcctaaatgattagagcagaaaactcttctgaattaagggtctgcaagacaaacaggttgccatagacatttataaggaaacagccattagcacacccatatgatacactttgctctttttttttttttttgagacatagccttgttctgtcacccaggctggagtgcagtggcacgatctcggctcactgcagcctctgcctcccaggttcaagtgattttcctgcctcagtcccccaagtagctgggactataggtgtgcaccaccaagcccggctaatttttgtatttttagtagagacagggtttcaccatgttgggcaggctggtctcgaactcctggcctcagatgatctgcccccctccttggcttcccaaagtgctgggattacaggtgcgagccactgtgcccagcctcactttgctctatcttttggcctggtttccccaggcactgtggagggaacacaaatatgagtcactgttcctgtcctccaactgcttcctgcctcttcagggagctcagccctgtactgtccaaagagaggactaccagactgggcaatatagcgagacaccacctttacaaaaaattttttagaaattagctgggcatggtggcacacacctgtagtcacggctacttgggaagctgaggtgagaggatcacttgagcccaggagtctgagactacagtaggctatcacaacactgcacgccagcctgggtgacagagcaagaccctgtctaaaaaaaataaaaataaataacaaagaggggactagcagagccatgtgggaagtagtaagtcacttgtagtaatagccacttgtaattaatcacttcacagatcaaagtagttcatatttagcctactcatcagcacctgactataaaggtgtcaggccagagtctccatttcacaacttaaattaaagtgattgttctcggccaggcgcaatggctcacacctgtaatcccagcactttgggaggccaaggccagaggatcacttgaggttaggagttcgagaccaacctggccaacatggcgaaaccccatctccactaaaaatacaaaaaaaaaaaaaaattagctgggtgtggtggtgcgtgcctgtagttccagctactagggagactgaggcaggagaattgcttgaacccaggaggcagaggttgcagtgattcaagatcacaccactgcacccagcctgggcgagagagtgagactctgtcaaaaaaaccaaaacaaaacaaaaaaaaaacaccaccaaagtgatcattctcatgtttgaattgggaaattaatttagactaaccaaactttagttgcctccttctcgaatgacatcagttcacttcccttccttcagctgccctccctccttcctcttaggccatttgggctgccaaaacaaaatatgataggctgactagctcataaatgacagaacttgagaaacagttccggagcctgggaaatccacaattgaagtgccgcagattcagtgtctggtgagggccactttctgggtcacagttggtgcctcctcgttgtgtcctcacatagtggaaggggcaagggaactctctgggtcctcttctcactgatgtcactcactaatcatcattcaaggccccacctcctaatatgattatattgggaataaggtttcaaggtactacttctggagggacacagacattcagataatagcactgccctctctcaattccttgagcatggctcacctctcctccagcccagggcacactgcatgaccatcagttgttttctggggtcaggctctggacctgaacccacaaggtcaggcacattcacttttgtattacatcccgggctcagcatggggcctggacccatgtaaggaggcaaatgagtgttaagggaggctgaaggtttgttgaaacttttggagtacctcattcacatgttcattcgttcatttactcactcatccaacagcatttttttttttgagacagggtctcactctgtcacccaggctgaagtgcagtggtgcaatcatgactcactgcaaccttgacctcccgggctcaagcaatccccccacctcagcctcccgagtagctgggaccacaggcacacaacgctatgcctggctaattttttcattttcagtagagacgaggtctcgctatgttgcccaggctggtcttgaactcctgggctcatgtgatccgcctgcctggcctcccaaagtgttgggattatagacgtgagccacggcgtctggccaccagcgatttcttaaatgtctatacacgcctgaaactgaaataaggccgggaagtctcttgcccacttagcaattacagagaagggatatatgggtttatagtaaatgtgacaagtaagtccagggggccctgggaacacacaggagaggcacagaacttgaacccagggtgtcagggaaggagtcctggggaaagtgaggtctcagctaacatctgaaggctgaacaggagtttgacatatgaatggggtgaggggatgtgggagctgggggccggatatctgaggaaacagttcagctttatttcagctggccgtgtggctttgagcaaacaagtcacaaaaattctctcagattcccattacta[131 bp omitted]cctgtctctactaaaaatacaaaaacttagctgggcatagtgccgggtgcctgtaatcccagctactcaggaggc[134 bp omitted]aagaaaaagaaaaggagcttcctcgtgcatccgttgtgagggttaaatgagatcatgtgggccaagtgcctggcatatagtagatgctcaatggacatctgatggcataggggcgcctcagcaatccctcagcatgacaccctgtattaaagccaggtagatctcttgtgttttgccaaagatccattttgagatcctattcaccttggctctcaagctgagagtagactaagaaggcctcaagtgttcagctagtgatgacagctgagcaaaccaataggtagttactgcacacgccaggccatcagatgccaaaaaattttgttttgcaaattatatagaccaaaagggaaattgagcctgaaagttccagtgtgtggatgcgagaacacactaaagaaatctctacctgaagcctggggaaggggctgctgatggtgctcttctcacatcatactcagctcctgccaccattagcagcttcatcttccttttaaaaatttttattgaaaatagagacaaggtctc[131 bp omitted]agagggcagatttcaagtttaggatcctgaatttctctgtatggaagtgagcagatcacaccttctcaagcagggaaatgctcagctctgccaaaaagagaaacaagttattgagactgagaaatccgacatttttggtgagttagctgagtttgcaaacagtaaactgtgttttcaaagacataatgctgtagcaatatcttcagaataaaatcaggtaatgtaattgatcctaaatttgttattttggagccaagtaatcaatagctgcctggtgacctgggcatcttccttctagatcatggctctgtgaggacagcagctctgcccatgttgttcaccacagggctgaacaccgtgccacatacttggcattcaaaattgttttttctccaacctgggcgacagagtgagaccccgtctctaacaaaaaaagaaaaaaaaattttgttgaatgagtgaattttgattagatagatctaatacattgtataacgttcataagtgtttctctcctaagtccaatcctgaattcttgtgtaataataacctcattgaattattttagcagaataattggatatcaaggatgggtgtgtcggctaccaaatcactccatcatattagacttctctctttgagaaccctgacatggctccatgatccataggaacacacgtgtctgtgtgtgtatgcatataatgtacacacatctgtttgtccgaacaacggccatataaagattgtgtaactgtcaagagcctttccagctcattagatgggttcctggacatctcttaactctgtggttcagctttccccctgcaaagtggagatgtatttcagtttcctatttcagtgaaagtttagaagaattatcgtgacatcattttcctgaatgacaaatgtccacttagctgcagggaattccttctaggaaactgaagatcaaaaattgaaaatttatattacaaagcaatattaagatgtacgcctttttttttttttttgagatggagtcttactctgtagcctaggctggagtgcggtggcacaatcttggctcactgcaacctctgcctcccgggttcaagcaattctcctgcctcagcctcctaagtagctgggattaccggcgcacaccaccacacctggctaattttttttttgagatggagtctcgctctgtcacccaggctggagtgcagtttcacaatctcggctcactgcaagctccgcctcccaggttcacaccattctcctgcctcagcctcccgagtagctgggactacaggcgcccgccaccacacccggctaattttttgtatttttagtagatatggggtttcaccgtgttagccaggatggtctcaatctcctgacctcgtgatctgcccgcttcggcctcccaaagtgctgggattacgggcgtgagccaccacgcccagccacacctggataatttttgtatttttagtagagatggggtttcaccatgttagccaggctggtctccatctcctgacctcgtgatctgtccgccttggcctcccaaagtgctgggattacaggtgtgagccaccgcgccaagccagggtttttgtttttgagacagggtcttgcttggctgcccaggctagactccagggacacaatcatgactcacagcagcctcgaactcccagactaacatgatccttccacctcagcctcctgagtagctgggaccacaggcatgcaccacgatgcccagctaattattttttaatttatactttgtagagatgggggtcttcccatgttgcccaggctgctctcaaactcctgggctcaagcgatcctcctgcttcagcctcccaaaatgctgagattacaggcataagccatcgcacctggcctgtatttttttttttttaagagatggggttggctgggcacagtggctcacgcctgtaaccccagcactttgggaggctgaggtgggtgaatcacgaggtcaggagatcaagatcatcctggctaacatggtgaaaccctgtttctactaaaaatacaaaaattacccaggcgtagtgtcacacacctgtagtctcagctactcgggaggctgaggcagaagaatcgcttgaacctggcaggcggaggttgcagtgagctgagatcatgccactgtactccagcctgggcaacagagcgagactccatctcaaaaaaaaataaaaagagagacggggtcttgctgtcacccaggctagaatgcagtggtgcaatgatagttcactgcaacctccaactcctgggctcaaggaatactcctaccacagcctcccaagtagctgggactacaggcatgtgccaccgcaccccgccaattttttttttttttagtggacacagggtcttgctatgttgcccaggctagcctcaaactcctggcctcaagtgattatcttgccttgcctcccaaagcactgggcttacaagcatgagccatggtgcccagcaatataataatactgtactagagaatgtttttgaaaatcttcagcaaaaatgatacttctttgtatgaggagagatttccagccacttagtgccaacaagttcctgatggagattacaatttaacattatgggtttggttttgagaccaactgaaaattccaactactctttggcaatagaaagaattttgtaatagactgagcaaacatatcaaaacaggtgatttttgactgggcgtggtggctcatgcctgtaatgccaccactttgggaggctgaggtgggcggatcacctgaggtcaggagtttaagaccagcctggccaacatgatgaaaccctgtctcttctaaaaatataaaaaattaggtgggcatggtggcgggtgcctgtcatcccagccactcaggagactgaggcaggagaattgcttgaacctgggacacggaggttgcagtgagctgagatcgcgccattgtactccaacctgggcaacaaaagtgaaactctgtctcaaaaaaaaaagaagggctgggcgcagtggcttatgcctgtaatcccagcactttgggaggccaaggtgggtggatcacctgaggtcaggagttcgagaccagcctggccaacacggtgaaaccccatctctactaaaaatacaaaaattagctgggcatggtggtgtccatctgtaatcccagctacttggcaggctgagggaggagaacgcttgaacccaggaggcagaggttgcagtaaatcgagatcatgccactacactccagcctgggcgacagaacgagactccgtctcaaaaaaaaaaaaaaaaaaattagcaccttcacattggttattcacactaattaggcattcaaattgtataccatcacttgcccacagtataccttgtagagacacttacttggtgaaagttcataattgctttaaaaaacttttttgaatttccagtagttatcaccacaatttctaagacaagaaaggctgttgtgtcatcagggttggtttctggtgaggcctctctccttagctttcaaacggctgccttcttgctgtgtggcctcacatggtcttttccccgtgcatgagcgtccatcacgtctcttcttataaggacaccagtcctattggattaggaccctccttttatgacctcatttaacctgaattacctccctaaaggccctatctcaaatacggtcacatctggggttagatcttcaatatatgaattaagggaggggagacacaattcagtccatagcaccccctttgcaaacaatctaccccaaatgcatctagtgatacacaagatgttttactccatttacttgctttgatttcagtacatggtttcttctgggaaaataaaatctttgggatgaagaaagtggtccaaaagctggctggacctctatggctactaactgccctataggctggcatctgtttttactctttgtgaaacctaaacctacagtaggttgttcagggatactacaagtaagtattcagagaaatcttggctcactgtaacctccgcctcccaggttcaagcgattctcctgccttagcctctccagtagctgggattacatgcccggctaattttttaatttttagtagagacagggtttcgccatgttggccaggctggtctcaaattcctgacctcgggtgatctgcccacctcagcctcccaaaatgctgggattataggcgtgagccactgcgcccgacccagagtttcactcttgttgcccaggctagagtgcaatggcgcaatctctgctcactgcaaactccgcctcctgggttcaagcaattctcctgcctcagcctcccaagtacctggaattacaggtgctcgccaccatgcctggctaatttttgtatttttagtagagacggagtttcaccat[137 bp omitted]cactcacacatgctatgctaacactacgtatatgtacatatttatcacctaatcttctgaaaactcaattgatcataagattataaacacacatactgcatttttccctaagttgccaaacttagtctcctccccccaccaacccccaccaaaaaaactctttctcttcaagttgccataataaaggtctaaaatggggttgatgatggtgataaaatccttactatttaaatggctactgatttataaggcaagctatatttattggaatgtgggattctttttagcattttattctattcaaataggctttttcttttattcataagctaaagattttcttttcttccctcttgccttctttaattgtattacttttgtttgtgtttctctaaaagaggttatatagtttattctgtttgactataccatattacaaccattagggcaagatcccaaagaaaaacaatgcacctctcacctcctacggcgcctgcgcagaggtactaaagtgaagtatgcatgttacaaggccagccaccctcagaaacattcaatgatgactaaatgctcacactttatctgaacctttgatgtgttgtacccagctctctaatcctctgcacacgatcttcctcgggacaagacctgatacaaagatcagtgtgtgttttcagcagtggaggcagcactgggctctttgagtttccaagctaattaagggaaatttgtcccagttggtgaaggcagatgccttaggggtcagtcttcctaacattttgggcaccaagttaaaaaatcaacagtcccccttcccttcatcatgtgacttaccccagggcaatgaattgggtcccctctgctccatccctataaatcatacatttatacatactgttacatattttattcatttatttgtgagacatagtcttgctgtgtcacccaggctggagtgcagtggcgcaatctcggctcactgcaaccttcgcaacccgcgttcaaatgattctcctgcctccgcctcccgagtagctgggactacaggcgtgcaccaccatgcccggctaattttcgtatttttagtagagacggggtttca[134 bp omitted]tacttctatttcaacttacataaacatgaaatgtaaaaatttcaatctgtaaagaggtaagtggctacctcacctacgatgtggtaaataagacgtgtcaacgcagccatcctgccccagccgaccagaccttaatgctccaaaaccatccgtttgcgcctggaaaactgaggaaagtgtttattcccttacacacgcttcgccaaaggccctggcacgtagggctttttcactgctgcgaacgttagaccggcctgtgataaggagtacaattaatctaactttggtatactatatccagagaccacagggggctcgctctgcgatttatggtgcgaggaggaccagacaccccctgtgcccgtcctactcctgcagatcaaactcacagccacacttttcggaatgagaaactggacagtaaatgaacgcaagaaccatggtgcccaggcagagaaccccgctgggtttgctacgaaggttgcggtggaggcgcccagtgcaccaggcgccaaggcccggtatgtgacctcactaacctccgccagcgcgcaccctgtcctgccccttctcgggccaacaaccccacacgacgcagcggtgtgagaaccagcaaccggaaccgcaaaagcacggctttcccggagcccgggctctggactggcacccactgcgcatgctccagagcggcgaccaatgggagcccggcgcgcagggacggaggcgggcccgggccgctaccgagaagcacagggacccgacttcagtcatcgaccaatcagagctcacagccccccacaccccctcccccccggccctgagccaattgccagctcgtgtgcgggagggccgggtcaagactaagtcaaaggaggagagggcaacgcggtgggcaggagagaggccaacggccgcccggggcgaggggagccggtaggacgggaccaggactggccgacccggccccgcgcggggaagggggcgccttcctcccacaacacaaaacggtgcgcccgggttggccgcccctccccagtggtgcggccccgggtggacgcttccgtgcgcgcgtccatgcccagccattgcgggctgcgggctccaagggtcgcacacgctggagagtgcaggttgccgggtccacccacagggctgtagacacccctagggtcacacagacaaggctctggacacccacaggggcacacacattggggagtgggcactcctgggctcacaaagactgaggcgcaggaaggtagggcgcgcccgcccagagggagttggtggtggctgagggtgagggcaaggtagggactgggaggagacttctggttccctggttggtcctggtggggcctgactgggccagggttttcctgtgcaggtgcggggagtagggcggggtctctggttggcggggagggctccaggagcctgtcccagccctgggggtgtctggctgagccccacagaagggaactctgagatgggctttgcagcaggggaaagaaaagggaggtcgcgcatactggcttcctgaccatccaccaatggtggtggaacctggaagcctgagggaggaaggtgaggaggcgcttgagggaggggggaatctaggcgtcagggatgatagttcattgatccaagttactcagctatttcatagaaacggcaacagtaatgaataattataacacgtgccaagctctcctgatcactttacacaaatcatctcactgcatcttcacaacaaccttaactactattatcatcttcgcgttctggatgagagacctgaggccctgtagaggttaccagaaggcacacagctgagaagcgccagggccagggcaagggtcaggctgtgcactctggactctgtgttctgaccactgcgtcattgactctacagatgtctctgctttctgtgctcaccctgtcctcattccgcccccggcaggacagagggcccctgaagcatccatttgcccacagcgtcagtgaactgtgtagaactctctgtgcaagggagctggcccctgcgcaccctgagtcgtttttcttccctggctccccacgcaggggcagtgaacagaggagagggaagccttgttggaagagggcagtaaatcacagcatagctatccagactgcaattatttacttagtgcattcagggtcttgtgctaggtggtggggataccgcactgaaccagacagacaagggtcctgttcctgcctgccctcggggtgtgttttgggaattcctccttgagggtgctttggcattgaatgggcagaggtctggtgctggggggctgtcccacaccagcaagacttgtaatgtacatgaatgtgaatgtcatttcaggatagtaaaaggaggcctccaaaaatgtttcttattaaaagggagcattgggtctgagggttgggaaatgatatttccttaggtcaggcctgtcccaggaagcaaccctcagtcagggatacggaggaccatgaagatagtacggtgaggggaggaggaagatacagcaacgtaaattttgccatcttggcctcagtttggttttaaaggacagcagttggaccctccccatgcctaggtctcctgcatggattcagtcagtggtggcccaggtgtggaagacaccccccatgtcttattacctactctgggcttggggtgtggtgatcaggaccttgtagtcaatatcttcccaacaagaagcaaaataagaacaagatataaacaggaggtgattcatctggtgcccctaggggttggaggggaaggtgatggggtccatcctggttcttgggggttcctggtgtttgctgtattactgtgaagtaaattaacacttctgctgtgtgaactggcttgcattagaccaactctcctgctgagagcaaccagaaaagctggattaaagttcctgtttttgtttttgagtctatttgaaggcccaggagagcaaattatctttgaggtcatcacctcaccaagtactggcatccagtgcagaacagcaagagttgatgagaacatcagactagaagaacggagtgaaaaaaatttaaattttttttaaaaagagtttgtggatacatataaacgtaataaaccagctccaaattattgatgccagtcaatggagtaatcaaaaaatatgaatatgaaaagtgatactaaaatgattagtaaatcactatagtctataatgggaaaactcattctattagggactaaaataacaaaaatgtgctttaagtttttctttcttttttttttttcaagagccgacgtcttgttctgttgcccaggctagagtgcactgaggcaatcacagctcactgcagcctcgatttcctaggctcaagcaatcatcccgcctcagcctccccgactacaggcatatgccaccacacccagctaatttttaaaaaactttttgtagagatggggttttgctatgttgcccaggctggtctcaaactcctgggctcaagcgatccacctatcttggcctcccaaaatgctggattacaggggtgagccaccacgcccagcctgcttcaggtttttttgttttgttttgttttgttttttagagaaaaatatacattttacacttgtctgctacttagaaataagaacaggaaatatacaactttaaaaaattcattctcataccttggtaacgaaatatccacctttaaatgttaatttataaaacaaccagcacaaccagcaaggctgttgtggctcacacctgtaatcccagcactttgggaggtggaggagggcagaatgcttgagcccaggagattcagaccaggctgggcaacatagtgagaccccatctctacaaaaaatatgataattagcgaggcatggtggtgcacacctgtagtcccagctacttgagaggctaaggcaggaggatcccttgagcccaggaggtcgaggctgtattgagccgtgattgcaccactgcacttcagcctaggcagcagagtgagactttgtctcaaaaataaataaatagttaaataaaacaaccagcagctgctctgcctatggagtagtcattttttattcctttactttcttaatacatttgctttcactttattctatggacttgctccgaattctttcttgtgtgagatccaaaaaccctctcttgggtctggatcaggacccctttccggtaacatcttcctggtgaaccacgaagggatgatactgaggagaccctcgacccaaaggaaaaagactgcagcactgattggccaactttggactgaccctgcttattcctgtgaaccaatcagtgacctgtgacggctcctcagaagaaacaagagggatggacaacaccttttgttggagctcagttatgagtggctcagttatgactgagctcccttctaccctgaatacaagagaccctaataggcaggaatatcatcgcccctattcctcctgaagaagttacagaagatgaatcttcctccctctaaaccgttaggattaagggtttccttgtaaaagggaagggcaaatatgtcagaggcgtttgaaccagagtgattctatcttgaataggggctgggtaaaataaggctgagacctactgggctgctcctgggctactcccaggaggttaggcattctaagtcacaggatgagataggaggtcagcacaagatacaggtcacaaagatcttgctgataaaacaggttgcagtaaagaagctggctaaaagccaccaaaaccaagacagcaatgaaagtaacctctggtcttcctaactgctcattatacactaattatgatgcactagcatgctaagagacacttccaccagcgccatgacagtgccatggcaacatcaagaagtcaccccacatggtctaaaaaggggaagaaccttcagttcccggaattgcccacccctttcctggaaaactcatgaataatccaccccttgtttagcatataattaagaaataactgtaagtatccttagtccagcagcccaagctgctgctctgcctatggagtagccattctttattcctttactttcttaataaacttgctttcacattaaaaacaacaacaacaacaccaacaaccagcaaatatatcagaggcttagcatcccctattcaaggggacagttctggaggccgagaaagaagtagaaaggtggagaataaaagacacaaaggagcagaagaattttatcttggcctccatgtggcacctcacagcttgggaacaacaatttctctcataattttcctcagctccaccactcacaagctgtgtgacctcgggcaaggcacccaagctcctctgggcctcagcttcccagtcagtacaatggggtaacagtagtgcttacgttttttgtgtttttttttgagatggagtcttgctcttgtcacccaggctgaagtgcaatggcacgatctcggctcactgcaacctccgcctcccaggttcaagtgattctcctgcctc[213 bp omitted]tgtgaaatgagttaataaatggaaagcacttagaaaagcctctggaaccactgaatcaaattggatatcattactgaaccttcattcaatgcttcaatacccatttagtgtcatctgtccaaatgctggagatacgcctagcacacactgactgctcagtgagcagtgtcacaatgaacacgtgcaatggccttgaaggccacatcggggcttgccctgatcagcaggttggaggtgctccaggcccgaagcttagctgtgagtggggacacgggagggaggttggaactgccactgcagaaggggttctgaacctaggttcaggagagaggctttgaacctgcacgtgtgggaagccatggaagtttccaggaaggactgcaggtcccaactggagatgtgccgttcctccttcaggtacctgggaatgtcagtcacaccccagacctgctcagctcccccaaactgctgttcctgtatctgagagcttcaagtctccaaatggcctacctcatacatggggaaactgaggcctggggaggccggggactgagctagcattcacttgtggaaatagtctggcatcatctggagaagttagagacatgcaaaccctacagccctcagattcccgtctgagagtctgcatgcctatgtggaccaggagatgtgtgcgggagtgaacactgcagtgttgctcccaacagcaagaaccagaagcagcccaaagggctgttacaggagaatatggacacccaggctgcacatgcacaccatggaatgctgtatggcagtggaaataaatgaacagctaccactataggcaaacaggaatcacagcaacagccaagagtgaaggcgtggagggacgagaccatgcactcacacctggcctgcctggctcgcactccgggcaaaggggtcagaacagtgactggcacacacgttaagtgctatgtgagtgttaagataaaactaggatgtccagtggggagaaagcaagcctttgaagattatgtgcttttacaaacttcaagtgcaatgaaaactaaacaagatgttgttcaggcattcatatatgatataaagttcctttctttaaaaaagggatgggctgggcacggtggctcacgcctgtaattctaatactttgggaggccgaggcaggtggatcacgaggtcgagaaatcgagaccatcctggccaacatggtgaaaccctgtctctactaaaaatacaaaaaaattagctgggcgtggtggcgtgtgcctgtagtcccagctacttgggaggctgaggcaggagagtcacttgaacccgggaggcaaaggttgcagtgagccgagatcgtgccaccgcactccagcctggcgacagagtgagactccatctcaaaaaaaaaaagaaaaaaaaaagtatgacaagcagaaagtaatttgggagctgcggggaggcaagggtaagggatggggaagtggaccagaggcatatgcgtcattggcagtgtctaagcactcacgataggcgtggatcacaggggctcgctctgtaattaaaaggaaaagggtttttgttgtgttgttgttgttgctgtttttgagacaagggtcttgctctgtcatcatccaggctggagtgcagtggtgcagtctcagctcactgcaacctccgcctcctgggttcaagcgattctcctgcctcagcctcctgagcagctaggactacaggtgtgtgccaccatgcctggctaatttttgtattttttagtggaaatggggttttgccatgttgcccaggctcgtcttgaactcctgacctcaagtgatccactcgtctcggcctcccaaagtgctgggattacaggtgtgagctattgtccccagccaaaaggaaaagttttactgtagtaacccttccggactagggacctcgggcctcagcctcaggctacctaggtgctttagaaaggaggccacccaggcccatgactactccttgccacagggagccctgcacacagatgtgctaagctctcgctgccagccagagggaggagggtctgagccagtcagaaggagatgggccccagagagtaagaaagggggaggaggacccaagctgatccaaaaggtgggtctaagcagtcaagtggaggagggttccaatctgatggcggagggcccaagctcagcctaacgaggaggccaggcccaccaaggggcccctggaggacttgtttcccttgtcccttgtggttttttgcatttcctgttcccttgctgctcattgcggaagttcctcttcttaccctgcacccagagcctcgccagagaagacaagggcagaaagcaccatgagtgggggcccaatgggaggaaggcccgggggccgaggagcaccagcggttcagcagaacataccctccaccctcctccaggaccacgagaaccagcgactctttgagatgcttggacgaaaatgcttggtgagctggggatctcctgcccccgccccgtccccaccgtttcttcctcttcctctcctccttctctctcttcccctcctcccgctcctcctttccctctccatcatctcctctcctagaatttcccgtcataatccacccttcccaggaagatctcaatgtctacttgccttccctctggctgcagctcttcctttgggcccatgactgtcatgaggcaggaaggaccaggtctggctccaagaccttgtggctacccctgaccagactccactgacccctgctttcctctcccagacgctggccactgcagttgttcagctgtacctggcgctgccccctggagctgagcactggaccaaggagcattgtggggctgtgtgcttcgtgaaggataacccccagaagtcctacttcatccgcctttacggccttcaggtgacccccccacccccgactggacttgcaagccagttctcaacccgcaaacccagatctgtgtccatatgtgtccatagcttcaagacctcagacctgatcagtgaatccctgagccccagaaccaaagactcatccagatggcaaactctgacttgcctttctaagtctgcaatgactggccccagtctccgtatcaagatctctaaagcccccagtattagtctgctgcctaagcctaatcttttccacaaattccaataaatgagcactgtatttgtacctgaacctcaaatctattctaaactcaacattttgcatcccaggaatctctcatcaaaactcctgaaccccagatgtttgccaagctcctaagtcataaatctgttcaacaaaccccaaagttgaatattccattgatccttgaactccaaatctgtccttctaaatccacagcacagaccccagagttcccatattaaaattcctgaacactcaaataccgaggtagttcttaagcaaaaagtcttttccacaatcccctgacctgaactttctaggtttaagccccaaattcatccttttaaacccataaagatggacccagcataacttccagatcccaaggctatcaaatatccaccaaactcctaaaccataactctctccacaaaccccaaattgcacttactttagctggactccccgcgaaactcccaagtctatgtgtctgaacttcaaatctcaactccaacccccaaatactagaatcctacctgtcatgaattggggctggggtggtgggggagggcatggattgaatctgtgaatgagcctcaacttcctaagactagagtcctaaattatgaaattcaagcccccaagtcccagatctagggccccaaaccccaaatccaaacctctcacaaaa
